US007332310B2

(12) United States Patent
Nakagawa et al.

(10) Patent No.: US 7,332,310 B2
(45) Date of Patent: Feb. 19, 2008

(54) **MUTANT OF HOMOSERINE DEHYDROGENASE FROM *CORYNEBACTERIUM* AND DNA ENCODING THEREOF**

(75) Inventors: Satoshi Nakagawa, Machida (JP); Hiroshi Mizoguchi, Machida (JP); Seiko Ando, Machida (JP); Mikiro Hayashi, Machida (JP); Keiko Ochiai, Machida (JP); Haruhiko Yokoi, Machida (JP); Naoko Tateishi, Machida (JP); Akihiro Senoh, Machida (JP); Masato Ikeda, Machida (JP); Akio Ozaki, Hofu (JP)

(73) Assignee: Kyowa Hakko Kogyo Co., Ltd., Tokyo (JP)

( * ) Notice: Subject to any disclaimer, the term of this patent is extended or adjusted under 35 U.S.C. 154(b) by 541 days.

(21) Appl. No.: 10/805,394

(22) Filed: Mar. 22, 2004

(65) Prior Publication Data

US 2006/0228712 A1    Oct. 12, 2006

Related U.S. Application Data

(62) Division of application No. 09/738,626, filed on Dec. 18, 2000, now abandoned.

(30) Foreign Application Priority Data

| Dec. 16, 1999 | (JP) | ............................ P. 11-377484 |
| Apr. 7, 2000 | (JP) | ........................ P. 2000-159162 |
| Aug. 3, 2000 | (JP) | ........................ P. 2000-280988 |

(51) Int. Cl.
| *C12P 13/08* | (2006.01) |
| *C12N 1/21* | (2006.01) |
| *C07H 21/04* | (2006.01) |
| *C12N 9/04* | (2006.01) |

(52) U.S. Cl. .................. 435/115; 435/190; 435/252.3; 435/252.32; 536/23.2

(58) Field of Classification Search ...................... None
See application file for complete search history.

(56) References Cited

FOREIGN PATENT DOCUMENTS

| EP | 0358940 A1 | 3/1990 |
| EP | 0387527 A1 | 9/1990 |
| EP | 0555 661 A1 | 8/1993 |
| EP | 0974647 A1 | 1/2000 |
| WO | WO 88/09819 | 12/1988 |
| WO | WO 93/09225 | 5/1993 |
| WO | WO 01/00843 A2 | 1/2001 |

OTHER PUBLICATIONS

Hirao et al, Applied Microbiology and Biotechnology, 1989, vol. 32, No. pp. 269-273.
Database Geneseq Derwent, Jun. 30, 1999, Accession AAX24102.
Koffas et al, Applied Microbiology and Biotechnology, Sep. 3, 1998, vol. 50, No. 3, pp. 346-352.
Database EMBL, Jan. 5, 1998, Accession AF038548.
DATABASE EMBL, "DNA sequence in the upstream of the start codon of homoserine kinase gene", Oct. 7, 1997, Accession E01359.
DATABASE EMBL, "*Corynebacterium glutamicum* hom-thrB genes for homoserine dehydrogenase and homoserine kinase", Apr. 2, 1988, Accession Y00546.
Peoples et al, Molecular Microbiology, 1988, vol. 2, No. 1, pp. 63-72.
Richmond et al, Nucleic Acids Research, 1999, vol. 27, No. 19, pp. 3821-3835.
Fleischmann et al, Science, Jul. 28, 1995, vol. 269, No. 5223, pp. 496-512, 507-512.
Hirao et al, L lysine production in continuous culture of an L lysine hyperproducing mutant of *Corynebacterium glutamicum*, Appl. Microbiol. Biotechnology 1989:32(3),269-273.
Waterman et al, Proceedings of the National Academy of Sciences of the United States of America, Jul. 1992, vol. 89, pp. 6090-6093.
Database Uniprot, Homoserine dehydrogenase (EC 1.1.1.3) (HDH), Aug. 1, 1998, Accession P08499.
Ohnishi et al, Applied Microbiology and Biotechnology, Feb. 2002, vol. 58, No. 2, pp. 217-223.
Loos et al, Applied and Environmental Microbiology, May 2001, vol. 67, No. 5, pp. 2310-2318.
Attwood et al., Oct. 20, 2000, Science, vol. 290, pp. 471-473.
Mewes et al., 1998, Nucleic Acid Research, vol. 26, No. 1, pp. 33-37.
Pearson et al., Proceedings of the National Academy of Sciences, vol. 85, pp. 2444-2448, 1998.

*Primary Examiner*—Elizabeth Slobodyansky
(74) *Attorney, Agent, or Firm*—Nixon & Vanderhye P.C.

(57) ABSTRACT

Novel polynucleotides derived from microorganisms belonging to coryneform bacteria and fragments thereof, polypeptides encoded by the polynucleotides and fragments thereof, polynucleotide arrays comprising the polynucleotides and fragments thereof, recording media in which the nucleotide sequences of the polynucleotide and fragments thereof have been recorded which are readable in a computer, and use of them.

6 Claims, 4 Drawing Sheets

MUTANT OF HOMOSERINE DEHYDROGENASE FROM *CORYNEBACTERIUM* AND DNA ENCODING THEREOF

The present application is a divisional of application Ser. No. 09/738,626, filed Monday, Dec. 18, 2000 now abandoned, the entire contents of which is hereby incorporated by reference.

The present application claims benefit of Japanese Patent Application Nos. Hei. 11-377484 (filed Dec. 16, 1999), 2000-159162 (filed Apr. 7, 2000) and 2000-280988 (filed Aug. 3, 2000), the entire contents of each of which is incorporated herein by reference.

The contents of the attached 3 CD-R compact discs (COPY 1 REPLACEMENT Jun. 12, 2006, COPY 2 REPLACEMENT Jun. 21, 2006 and COPY 3 REPLACEMENT Jun. 12, 2006) are incorporated herein by reference in their entirety. The attached discs contain an identical copy of a file "249-125.txt" which were created Jun. 8, 2001, and are each 25904 KB. The Sequence Listings filed in the parent application Ser. No. 09/738,626 on Dec. 18, 2000 and Jun. 29, 2001, are incorporated herein by reference. The Sequence Listing contained on the attached discs are the same as the "paper" and computer readable copies of the Sequence Listing filed in the parent application Ser. No. 09/738,626 on Dec. 18, 2000 and Jun. 29, 2001.

BACKGROUND OF THE INVENTION

1. Field of the Invention

The present invention relates to novel polynucleotides derived from microorganisms belonging to coryneform bacteria and fragments thereof, polypeptides encoded by the polynucleotides and fragments thereof, polynucleotide arrays comprising the polynucleotides and fragments thereof, computer readable recording media in which the nucteotide sequences of the polynucleotide and fragments thereof have been recorded, and use of them as well as a method of using the polynucleotide and/or polypeptide sequence information to make comparisons.

2. Brief Description of the Background Art

Coryneform bacteria are used in producing various useful substances, such as amino acids, nucleic acids, vitamins, saccharides (for example, ribulose), organic acids (for example, pyruvic acid), and analogues of the above-described substances (for example, N-acetylamino acids) and are very useful microorganisms industrially. Many mutants thereof are known.

For example, *Corynebacterium glutamicum* is a Gram-positive bacterium identified as a glutamic acid-producing bacterium, and many amino acids are produced by mutants thereof. For example, 1,000,000 ton/year of L-glutamic acid which is useful as a seasoning for umami (delicious taste), 250,000 ton/year of L-lysine which is a valuable additive for livestock feeds and the like, and several hundred ton/year or more of other amino acids, such as L-arginine, L-proline, L-glutamine, L-tryptophan, and the like, have been produced in the world (*Nikkei Bio Yearbook* 99, published by Nikkei BP (1998)).

The production of amino acids by *Corynebacterium glutamicum* is mainly carried out by its mutants (metabolic mutants) which have a mutated metabolic pathway and regulatory systems. In general, an organism is provided with various metabolic regulatory systems so as not to produce more amino acids than it needs. In the biosynthesis of L-lysine, for example, a microorganism belonging to the genus *Corynebacterium* is under such regulation as preventing the excessive production by concerted inhibition by lysine and threonine against the activity of a biosynthesis enzyme common to lysine, threonine and methionine, i.e., an aspartokinase, (*J. Biochem.*, 65: 849-859 (1969)). The biosynthesis of arginine is controlled by, repressing the expression of its biosynthesis gene by arginine so as not to biosynthesize an excessive amount of arginine (*Microbiology*, 142: 99-108 (1996)). It is considered that these metabolic regulatory mechanisms are deregulated in amino acid-producing mutants. Similarly, the metabolic regulation is deregulated in mutants producing nucleic acids, vitamins, saccharides, organic acids and analogues of the above-described substances so as to improve the productivity of the objective product.

However, accumulation of basic genetic, biochemical and molecular biological data on coryneform bacteria is insufficient in comparison with *Escherichia coli*, *Bacillus subtilis*, and the like. Also, few findings have been obtained on mutated genes in amino acid-producing mutants. Thus, there are various mechanisms, which are still unknown, of regulating the growth and metabolism of these microorganisms.

A chromosomal physical map of *Corynebacterium glutamicum* ATCC 13032 is reported and it is known that its genome size is about 3,100 kb (*Mol. Gen. Genet.*, 252: 255-265 (1996)). Calculating on the basis of the usual gene density of bacteria, it is presumed that about 3,000 genes are present in this genome of about 3,100 kb. However, only about 100 genes mainly concerning amino acid biosynthesis genes are known in *Corynebacterium glutamicum*, and the nucleotide sequences of most genes have not been clarified hitherto.

In recent years, the full nucleotide sequence of the genomes of several microorganisms, such as *Escherichia coli*, *Mycobacterium tuberculosis*, yeast, and the like, have been determined (*Science*, 277: 1453-62 (1997); *Nature*, 393: 537-544 (1998); *Nature*, 387: 5-105 (1997)). Based on the thus determined full nucleotide sequences, assumption of gene regions and prediction of their function by comparison with the nucleotide sequences of known genes have been carried out. Thus, the functions of a great number of genes have been presumed, without genetic, biochemical or molecular biological experiments.

In recent years, moreover, techniques for monitoring expression levels of a great number of genes simultaneously or detecting mutations, using DNA chips, DNA arrays or the like in which a partial nucleic acid fragment of a gene or a partial nucleic acid fragment in genomic DNA other than a gene is fixed to a solid support, have been developed. The techniques contribute to the analysis of microorganisms, such as yeasts, *Mycobacterium tuberculosis*, *Mycobacterium bovis* used in BCG vaccines, and the like (*Science*, 278: 680-686 (1997); *Proc. Natl. Acad. Sci. USA*, 96: 12833-38 (1999); *Science*, 284: 1520-23 (1999)).

SUMMARY OF THE INVENTION

An object of the present invention is to provide a polynucleotide and a polypeptide derived from a microorganism of coryneform bacteria which are industrially useful, sequence information of the polynucleotide and the polypeptide, a method for analyzing the microorganism, an apparatus and a system for use in the analysis, and a method for breeding the microorganism.

The present invention provides a polynucleotide and an oligonucleotide derived from a microorganism belonging to coryneform bacteria, oligonucleotide arrays to which the polynucleotides and the oligonucleotides are fixed, a polypeptide encoded by the polynucleotide, an antibody which recognizes the polypeptide, polypeptide arrays to which the polypeptides or the antibodies are fixed, a computer readable recording medium in which the nucleotide sequences of the polynucleotide and the oligonucleotide and the amino acid sequence of the polypeptide have been recorded, and a system based on the computer using the recording medium as well as a method of using the polynucleotide and/or polypeptide sequence information to make comparisons.

DETAILED DESCRIPTION OF THE INVENTION

Figure 1:
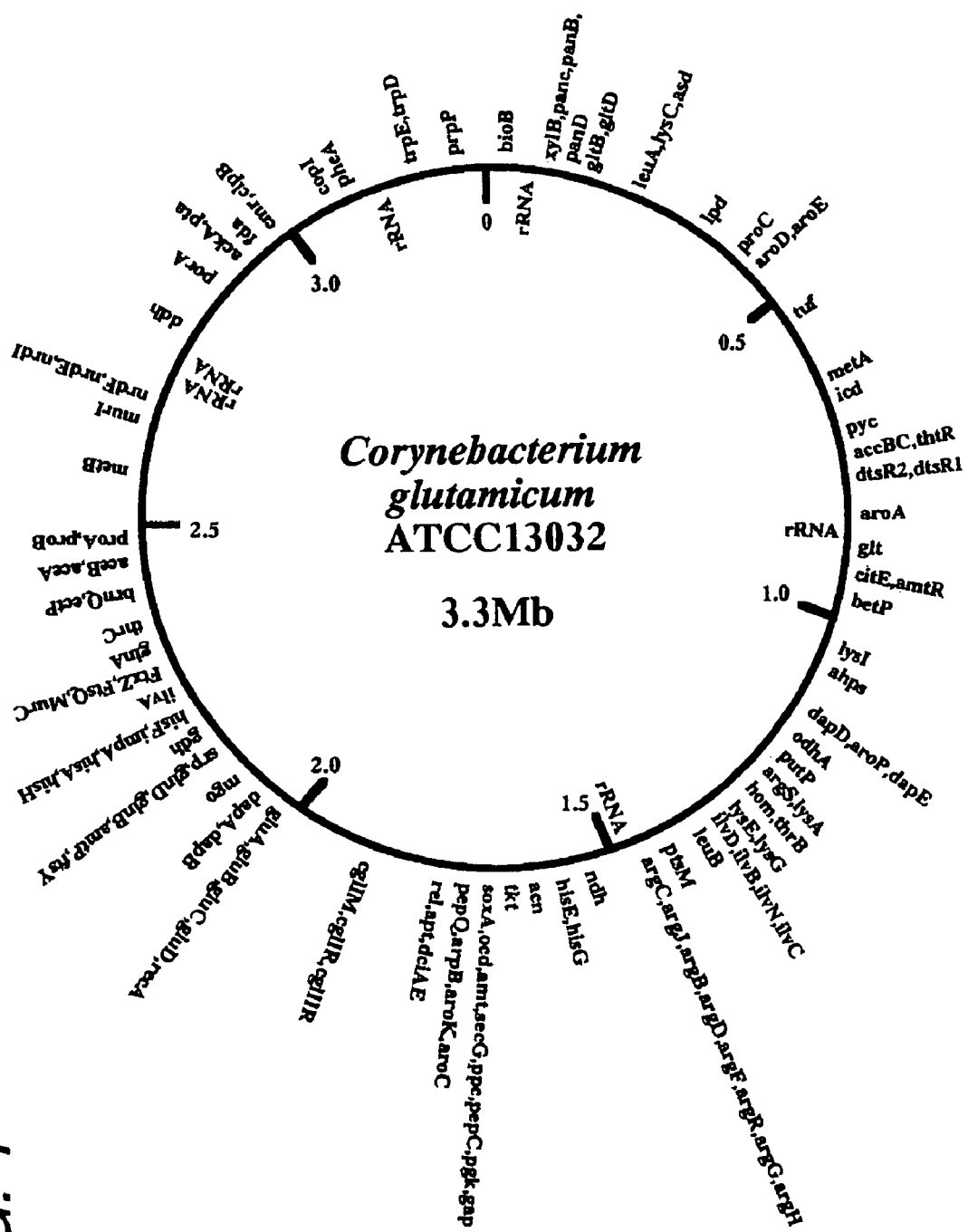
FIG. 1 is a map showing the positions of typical genes on the genome of *Corynebacterium glutamicum* ATCC 13032.

This application is based on Japanese applications No. Hei. 11-377484 filed on Dec. 16, 1999, No. 2000-159162 filed on Apr. 7, 2000 and No. 2000-280988 filed on Aug. 3, 2000, the entire contents of which are incorporated hereinto by reference.

From the viewpoint that the determination of the full nucleotide sequence of *Corynebacterium glutamicum* would make it possible to specify gene regions which had not been previously identified, to determine the function of an unknown gene derived from the microorganism through comparison with nucleotide sequences of known genes and amino acid sequences of known genes, and to obtain a useful mutant based on the presumption of the metabolic regulatory mechanism of a useful product by the microorganism, the inventors conducted intensive studies and, as a result, found that the complete genome sequence of *Corynebacterium glutamicum* can be determined by applying the whole genome shotgun method.

Specifically, the present invention relates to the following (1) to (65):

(1) A method for at least one of the following:
(A) identifying a mutation point of a gene derived from a mutant of a coryneform bacterium,
(B) measuring an expression amount of a gene derived from a coryneform bacterium,
(C) analyzing an expression profile of a gene derived from a coryneform bacterium,
(D) analyzing expression patterns of genes derived from a coryneform bacterium, or
(E) identifying a gene homologous to a gene derived from a coryneform bacterium,
said method comprising:
(a) producing a polynucleotide array by adhering to a solid support at least two polynucleotides selected from the group consisting of first polynucleotides comprising the nucleotide sequence represented by any one of SEQ ID NOS:1 to 3501, second polynucleotides which hybridize with the first polynucleotides under stringent conditions, and third polynucleotides comprising a sequence of 10 to 200 continuous bases of the first or second polynucleotides,
(b) incubating the polynucleotide array with at least one of a labeled polynucleotide derived from a coryneform bacterium, a labeled polynucleotide derived from a mutant of the coryneform bacterium or a labeled polynucleotide to be examined, under hybridization conditions,
(c) detecting any hybridization, and
(d) analyzing the result of the hybridization.

As used herein, for example, the at least two polynucleotides can be at least two of the first polynucleotides, at least two of the second polynucleotides, at least two of the third polynucleotides, or at least two of the first, second and third polynucleotides.

(2) The method according to (1), wherein the coryneform bacterium is a microorganism belonging to the genus *Corynebacterium*, the genus *Brevibacterium*, or the genus *Microbacterium*.

(3) The method according to (2), wherein the microorganism belonging to the genus *Corynebacterium* is selected from the group consisting of *Corynebacterium glutamicum*, *Corynebacterium acetoacidophilum*, *Corynebacterium acetoglutamicum*, *Corynebacterium callunae*, *Corynebacterium herculis*, *Corynebacterium lilium*, *Corynebacterium melassecola*, *Corynebacterium thermoaminogenes*, and *Corynebacterium ammoniagenes*.

(4) The method according to (1), wherein the polynucleotide derived from a coryneform bacterium, the polynucelotide derived from a mutant of the coryneform bacterium or the polynucleotide to be examined is a gene relating to the biosynthesis of at least one compound selected from an amino acid, a nucleic acid, a vitamin, a saccharide, an organic acid, and analogues thereof.

(5) The method according to (1), wherein the polynucleotide to be examined is derived from *Escherichia coli*.

(6) A polynucleotide array, comprising:
at least two polynucleotides selected from the group consisting of first polynucleotides comprising the nucleotide sequence represented by any one of SEQ ID NOS:1 to 3501, second polynucleotides which hybridize with the first polynucleotides under stringent conditions, and third polynucleotides comprising 10 to 200 continuous bases of the first or second polynucleotides, and
a solid support adhered thereto.

As used herein, for example, the at least two polynucleotides can be at least two of the first polynucleotides, at least two of the second polynucleotides, at least two of the third polynucleotides, or at least two of the first, second and third polynucleotides.

(7) A polynucleotide comprising the nucleotide sequence represented by SEQ ID NO:1 or a polynucleotide having a homology of at least 80% with the polynucleotide.

(8) A polynucleotide comprising any one of the nucleotide sequences represented by SEQ ID NOS:2 to 3431, or a polynucleotide which hybridizes with the polynucleotide under stringent conditions.

(9) A polynucleotide encoding a polypeptide having any one of the amino acid sequences represented by SEQ ID NOS:3502 to 6931, or a polynucleotide which hybridizes therewith under stringent conditions.

(10) A polynucleotide which is present in the 5' upstream or 3' downstream of a polynucleotide comprising the nucleotide sequence of any one of SEQ ID NOS:2 on 3431 in a whole polynucleotide comprising the nucleotide sequence represented by SEQ ID NO:1, and has an activity of regulating an expression of the polynucleotide.

(11) A polynucleotide comprising 10 to 200 continuous bases in the nucleotide sequence of the polynucleotide of any one of (7) to (10), or a polynucleotide comprising a nucleotide sequence complementary to tie polynucleotide comprising 10 to 200 continuous based.

(12) A recombinant DNA comprising the polynucleotide of any one of (8) to (11).

(13) A transformant comprising the polynucleotide of any one of (8) to (11) or the recombinant DNA of (12).

(14) A method for producing a polypeptide, comprising:
culturing the transformant of (13) in a medium to produce and accumulate a polypeptide encoded by the polynucleotide of (8) or (9) in the medium, and
recovering the polypeptide from the medium.

(15) A method for producing at least one of an amino acid, a nucleic acid, a vitamin, a saccharide, an organic acid, and analogues thereof, comprising:
culturing the transformant of (13) in a medium to produce and accumulate at least one of an amino acid, a nucleic acid, a vitamin, a saccharide, an organic acid, and analogues thereof in the medium, and
recovering the at least one of the amino acid, the nucleic acid, the vitamin, the saccharide, the organic acid, and analogues thereof from the medium.

(16) A polypeptide encoded by a polynucleotide comprising the nucleotide sequence selected from SEQ ID NOS:2 to 3431.

(17) A polypeptide comprising the amino acid sequence selected from SEQ ID NOS:3502 to 6931.

(18) The polypeptide according to (16) or (17), wherein at least one amino acid is deleted, replaced, inserted or added, said polypeptides having an activity which is substantially the same as that of the polypeptide without said at least one amino acid deletion, replacement, insertion or addition.

(19) A polypeptide comprising an amino acid sequence having a homology of at least 60% with the amino acid sequence of the polypeptide of (16) or (17), and having an activity which is substantially the same as that of the polypeptide.

(20) An antibody which recognizes the polypeptide of any one of (16) to (19).

(21) A polypeptide array, comprising:
at least one polypeptide or partial fragment polypeptide selected from the polypeptides of (16) to (19) and partial fragment polypeptides of the polypeptides, and
a solid support adhered thereto.

(22) A polypeptide array, comprising:
at least one antibody which recognizes a polypeptide or partial fragment polypeptide selected from the polypeptides of (16) to (19) and partial fragment polypeptides of the polypeptides, and
a solid support adhered thereto.

(23) A system based on a computer for identifying a target sequence or a target structure motif derived from a coryneform bacterium, comprising the following:
(i) a user input device that inputs at least one nucleotide sequence information selected from SEQ ID NOS:1 to 3501, and target sequence or target structure motif information;
(ii) a data storage device for at least temporarily storing the input information;
(iii) a comparator that compares the at least one nucleotide sequence information selected from SEQ ID NOS:1 to 3501 with the target sequence or target structure motif information, recorded by the data storage device for screening and analyzing nucleotide sequence information which is coincident with or analogous to the target sequence or target structure motif information; and
(iv) an output device that shows a screening or analyzing result obtained by the comparator.

(24) A method based on a computer for identifying a target sequence or a target structure motif derived from a coryneform bacterium, comprising the following:
(i) inputting at least one nucleotide sequence, information selected from SEQ ID NOS:1 to 3501, target sequence information or target structure motif information into a user input device;
(ii) at least temporarily storing said information;
(iii) comparing the at least one nucleotide sequence information selected from SEQ ID NOS:1 to 3501 with the target sequence or target structure motif information; and
(iv) screening and analyzing nucleotide sequence information which is coincident with or analogous to the target sequence or target structure motif information.

(25) A system based on a computer for identifying a target sequence or a target structure motif derived from a coryneform bacterium, comprising the following:
(i) a user input device that inputs at least one amino acid sequence information selected from SEQ ID NOS:3502 to 7001, and target sequence or target structure motif information;
(ii) a data storage device for at least temporarily storing the input information;
(iii) a comparator that compares the at least one amine acid sequence information selected from SEQ ID NOS:3502 to 7001 with the target sequence or target structure motif information, recorded by the data storage device for screening and analyzing amino acid sequence information which is coincident with or analogous to the target sequence or target structure motif information; and
(iv) an output device that shows a screening or analyzing result obtained by the comparator.

(26) A method based on a computer for identifying a target sequence or a target structure motif derived from a coryneform bacterium, comprising the following:
(i) inputting at least one amino acid sequence information selected from SEQ ID NOS:3502 to 7001, and target sequence information or target structure motif information into a user input device;
(ii) at least temporarily storing said information;
(iii) comparing the at least one amino acid sequence information selected from SEQ ID NOS:3502 to 7001 with the target sequence or target structure motif information; and
(iv) screening and analyzing amino acid sequence information which is coincident with or analogous to the target sequence or target structure motif information.

(27) A system based on a computer for determining a function of a polypeptide encoded by a polynucleotide having a target nucleotide sequence derived from a coryneform bacterium, comprising the following:
(i) a user input device that inputs at least one nucleotide sequence information selected from SEQ ID NOS:2 to 3501, function information of a polypeptide encoded by the nucleotide sequence, and target nucleotide sequence information;
(ii) a data storage device for at least temporarily storing the input information;
(iii) a comparator that compares the at least one nucleotide sequence information selected from SEQ ID NOS:2 to 3501 with the target nucleotide sequence information, and determining a function of a polypeptide encoded by a polynucleotide having the target nucleotide sequence which is coincident with or analogous to the polynucleotide having at least one nucleotide sequence selected from SEQ ID NOS:2 to 3501; and (iv) an output devices that shows a function obtained by the comparator.

(28) A method based on a computer for determining a function of a polypeptide encoded by a polypeptide encoded by a polynucleotide having a target nucleotide sequence derived from a coryneform bacterium, comprising the following:

(i) inputting at least one nucleotide sequence information selected from SEQ ID NOS:2 to 3501, function information of a polypeptide encoded by the nucleotide sequence, and target nucleotide sequence information;

(ii) at least temporarily storing said information;

(iii) comparing the at least one nucleotide sequence information selected from SEQ ID NOS:2 to 3501 with the target nucleotide sequence information; and (iv) determining a function of a polypeptide encoded by a polynucleotide having the target nucleotide sequence which is coincident with or analogous to the polynucleotide having at least one nucleotide sequence selected from SEQ ID NOS:2 to 3501.

(29) A system based on a computer for determining a function of a polypeptide having a target amino acid sequence derived from a coryneform bacterium, comprising the following:

(i) a user input device that inputs at least one amino acid sequence information selected from SEQ ID NOS:3502 to 7001, function information based on the amino acid sequence, and target amino acid sequence information;

(ii) a data storing device for at least temporarily storing the input information;

(iii) a comparator that compares the at least one amino acid sequence information selected from SEQ ID NOS:3502 to 7001 with the target amino acid sequence information for determining a function of a polypeptide having the target amino acid sequence which is coincident with or analogous to the polypeptide having at least one amino acid sequence selected from SEQ ID NOS: 3502 to 7001; and (iv) an output device that shows a function obtained by the comparator.

(30) A method based on a computer for determining a function of a polypeptide having a target amino acid sequence derived from a coryneform bacterium, comprising the following:

(i) inputting at least one amino acid sequence information selected from SEQ ID NOS: 3502 to 7001, function information based on the amino acid sequence, and target amino acid sequence information;

(ii) at least temporarily storing said information;

(iii) comparing the at least one amino acid sequence information selected from SEQ ID NOS:3502 to 7001 with the target amino acid sequence information; and (iv) determining a function of a polypeptide having the target amino acid sequence which is coincident with or analogous to the polypeptide having at least one amino acid sequence selected from SEQ ID NOS:3502 to 7001.

(31) The system according to any one of (23), (25), (27) and (29), wherein a coryneform bacterium is a microorganism of the genus *Corynebacterium*, the genus *Brevibacterium*, or the genus *Microbacterinum*

(32) The method according to any one of (24), (26), (28) and (30), wherein a coryneform bacterium is a microorganism of the genus *Corynebacterium*, the genus *Brevibacterium*, or the genus *Microbacterinum*.

(33) The system according to (31), wherein the microorganism belonging to the genus *Corynebacterium* is selected from the group consisting of *Corynebacterium glutamicum*, *Corynebacterium acetoacidophilum*, *Corynebacterium acetoglutamicum*, *Corynebacterium callunae*, *Corynebacterium herculis*, *Corynebacterium lilium*, *Corynebacterium melassecola*, *Corynebacterium thermoaminogenes*, and *Corynebacterium ammoniagenes*.

(34) The method according to (32), wherein the microorganism belonging to the genus *Corynebacterium* is selected from the grow consisting of *Corynebacterium glutamicum*, *Corynebacterium acetoacidophilum*, *Corynebacterium acetoglutamicum*, *Corynebacterium callunae*, *Corynebacterium herculis*, *Corynebacterium lilium*, *Corynebacterium melassecola*, *Corynebacterium thermoaminogenes*, and *Corynebacterium ammoniagenes*.

(35) A recording medium or storage device which is readable by a computer is which at least one nucleotide sequence information or selected from SEQ ID NOS:1 to 3501 or function information based or the nucleotide sequence is recorded, and is usuable in the system of (23) or (27) or the method of (24) or (28)

(36) A recording medium or storage device which is readable by a computer in which at least one amino acid sequence information selected from SEQ ID NOS:3502 to 7001 or function information based on the amino acid sequence is recorded, and is usable in the system of (25) or (29) or the method of (26) or (30).

(37) The recording medium or storage device according to (35) or (36), wherein is a computer readable recording medium selected from the group consisting of a floppy disc, a hard disc, a magnetic tape, a random access memory (RAM), a read only memory (ROM), a magneto-optic disc (MO), CD-ROM, CD-R, CD-RW, DVD-ROM, DVD-RAM and DVD-RW.

(38) A polypepide having a homoserine dehydrogenase activity, comprising an amino acid sequence in which the Val residue at the sequence in the amino acid sequence of homoserine dehydrogenase derived from a coryneform bacterium is replaced with amino acid residue other than a Val residue.

(39) A polypeptide comprising an amino acid sequence in which the Val residue at the 59th position at the amino acid sequence as represented by SEQ ID NO:6952 is replaced with amino acid residue other than a Val residue.

(40) The polypeptide according to (38) or (39) wherein the Val residue at the 59th position is replaced with an Ala residue.

(41) A polypeptide having private carboxylase activity, comprising an amino acid sequence in which the Pro residue at the 458th position in the amino acid sequence of private carboxylase derived from a coryneform bacterium is replaced with an amino acid residue other than a Pro residue.

(42) A polypeptide cruising an amino acid sequence in which the Pro residue at the 458th position in the amino acid sequence represented by SEQ ID NO:4265 is replaced with an amino acid residue other than a Pro residue.

(43) The polypeptide according to (41) or (42), wherein the Pro residue at the 458th position is replaced with a Ser residue.

(44) The polypeptide recording to any one of (38) to (43), which is derived from *Corynebacterium glutamicum*.

(45) A DNA encoding the polypeptide of any one of (38) to (44).
(46) A recombinant DNA comprising the DNA of (45).
(47) A transformant comprising the recombinant DNA of (46).
(48) A transformant comprising in its chromosome the DNA of (45).
(49) The transformant according to (47) or (48), which is derived from a coryneform bacterium.
(50) The transformant according to (49), which is derived from *Corynebacterium glutamicum*.
(51) A method for producing L-lysine, comprising:
culturing the transformant of any one of (47) to (50) in a medium to produce and accumulate L-lysine in the medium, and recovering the L-lysine from the culture.
(52) A method for breeding a coryneform bacterium using the nucleotide sequence information represented by SEQ ID NOS:1 to 3431, comprising the following:
(i) comparing a nucleotide sequence of a genome or gene of a production strain derived a coryneform bacterium which has been subjected to mutation breeding 50 as the produce at least one compound selected from an amino acid, a nucleic acid, a vitamin, a saccharide, an organic acid, and analogous thereof by a fermentation method with a corresponding nucleotide sequence in SEQ ID NOS:1 to 3431;
(ii) identifying a mutation point present in the production strain based on a result obtained by the
(iii) introducing the mutation point into a coryneform bacterium which is free of the mutation point; and
(iv) examining productivity by the fermentation method of the compound selected in (i) of the coryneform bacterium obtained in (iii)
(53) The method according to (52), wherein the gene is a gene encoding an enzyme in a biosynthesis pathway or a signal transmission pathway.
(54) The method according to (52), wherein the mutation point is a mutation point relating to a useful mutation which improves or stabilizes the productivity.
(55) A method for breading a coryneform bacterium using the nucleotide sequence information represented by SEQ ID NOS:1 to 3431, comprising:
(i) comparing a nucleotide sequence of a genome or gene of a production strain derived a coryneform bacterium which has been subjected to mutation breeding so as to produce at least one compound selected from an amino acid, a nucleic acid, a vitamin a saccharide, an organic acid, and analogous thereof by a fermentation method, with a corresponding nucleon of sequence in SEQ ID NOS:1 to 3431;
(ii) identifying a mutation point present in the production strain based on the result obtain by (i);
(iii) deleting a mutation point from a coryneform bacterium having the mutation point; and
(iv) examining productivity by the fermentation method of the compound selected in (i) of the coryneform bacterium obtained in (iii).
(56) The method according to (55), wherein the gene is a gene encoding an enzyme in a biosynthesis pathway or a signal transmission pathway.
(57) The method according to (55), wherein the mutation point is a mutation point which decreases or destabilizes the productivity.
(58) A method for breading a coryneform bacterium using the nucleotide sequence information represented by SEQ ID NOS:2 to 3431, comprising the following:

(i) identifying an isozyme relating to biosynthesis of at least one compound selected from an amino acid, a nucleic acid, a vitamin, a saccharide, an organic acid, and analogous thereof, based on the nucleotide sequence information represented by SEQ ID NOS:2 to 3431;
(ii) classifying the isozyme identified in (i) into an isozyme having the same activity;
(iii) mutating all genes encoding the isozyme having the same activity simultaneously; and
(iv) examining productivity by a fermentation method of the compound selected in (i) of the coryneform bacterium which have been transforms with the gene obtained in (iii)
(59) A method for breeding a coryneform bacterium using the nucleotide sequence information represented by SEQ ID NOS:2 to 3431, comprising the following:
(i) arranging a function information of an open reading frame (ORF) represented by SEQ ID NOS:2 to 3431;
(ii) allowing the arranged ORF to correspond to an enzyme on a known biosynthesis or signal transmission pathway;
(iii) explicating an unknown biosynthesis pathway or signal transmission pathway of a coryneform bacterium in combination with information relating known biosynthesis pathway or signal transmission pathway of a coryneform bacterium;
(iv) comparing the pathway explicated in (iii) with a biosynthesis pathway of a target useful product; and
(v) transgenetically varying a coryneform bacterium based on the nucleotide sequence information to either strengthen a pathway which is judged to be important in the biosynthesis of the target useful product in (iv) or weaken a pathway which is judged not to be important in the biosynthesis of the target useful product in (iv).
(60) A coryneform bacterium, bread by the method of any one of (52) to (59).
(61) The coryneform bacterium according to (60), which is a microorganism belonging to the genus *Corynebacterium*, the genus *Brevibacterium*, or the genus *Microbacterium*.
(62) The coryneform bacterium according to (61), wherein the microorganism belonging to the genus *Corynebacterium* is selected from the group consisting of *Corynebacterium glutamicum, Corynebacterium acetoacidophilum, Corynebacterium acetoglutamicum, Corynebacterium callunae, Corynebacterium herculis, Corynebacterium lilium, Corynebacterium melassecola, Corynebacterium thermoaminogenes*, and *Corynebacterium ammoniagenes*.
(63) A method for producing at least one compound selected from an amino acid, a nucleic acid, a vitamin, a saccharide, an organic acid and an analogue thereof, comprising:
culturing a coryneform bacterium of any one of (60) to (62) in a medium to produce and accumulate at least one compound selected from an amino acid, a nucleic acid, a vitamin, a saccharide, an organic acid, and analogues thereof;
recovering the compound from the culture.
(64) The method according to (63), wherein the compound is L-lysine.
(65) A method for identifying a protein relating to useful mutation based on proteome analysis, comprising the following:
(i) preparing
a protein derived from a bacterium of a production strain of a coryneform bacterium which has been subjected to mutation breeding by a fermentation process so as to produce at least one compound selected from an amino acid, a nucleic acid, a vitamin, a saccharide, an organic acid, and analogues thereof, and a protein derived from a bacterium of a parent strain of the production strain;

(ii) separating the proteins prepared in (i) by two dimensional electrophoresis;

(iii) detecting the separated proteins, and comparing an expression amount of the protein derived from the production strain with that derived from the parent strain;

(iv) treating the protein showing different expression amounts as a result of the comparison with a peptidase to extract peptide fragments;

(v) analyzing amino acid sequences of the peptide fragments obtained in (iv); and (vi) comparing the amino acid sequences obtained in (v) with the amino acid sequence represented by SEQ ID NOS:3502 to 7001 to identifying the protein having the amino acid sequences.

As used herein, the term "proteome", which is a coined word by combining "protein" with "genome", refers to a method for examining of a gene at the polypeptide level.

(66) The method according to (65), wherein the coryneform bacterium is a microorganism belonging to the genus *Corynebacterium*, the genus *Brevibacterium*, or the genus *Microbacterium*.

(67) The method according to (66), wherein the microorganism belonging to the genus *Corynebacterium* is selected from the group consisting of *Corynebacterium glutamicum, Corynebacterium acetoacidophilum, Corynebacterium acetoglutamicum, Corynebacterium callunae, Corynebacterium herculis, Corynebacterium lilium, Corynebacterium melassecola, Corynebacterium thermoaminogenes*, and *Corynebacterium ammoniagenes*.

(68) A biologically pure culture of *Corynebacterium glutamicum* AHP-3 (FERN BP-7382).

The present invention will be described below in more detail, based on the determination of the full nucleotide sequence of coryneform bacteria.

1. Determination of Full Nucleotide Sequence of Coryneform Bacteria

The term "coryneform bacteria" as used herein means a microorganism belonging to the genus *Corynebacterium*, the genus *Brevibacterium* or the genus *Microbacterium* as defined in *Bergeys Manual of Determinative Bacteriology*, 8: 599 (1974).

Examples include *Corynebacterium acetoacidophilum, Corynebacterium acetoglutamicum, Corynebacterium callunae, Corynebacterium glutamicum, Corynebacterium herculis, Corynebacterium lilium, Corynebacterium melassecola, Corynebacterium thermoaminogenes, Brevibacterium saccharolyticum, Brevibacterium immariophilum, Brevibacterium roseum, Brevibacterium thiogenitalis, Microbacterium ammoniaphilum*, and the like.

Specific examples include *Corynebacterium acetoacidophilum* ATCC 13870, *Corynebacterium acetoglutamicum* ATCC 15806, *Corynebacterium callunae* ATCC 15991, *Corynebacterium glutamicum* ATCC 13032, *Corynebacterium glutamicum* ATCC 13060, *Corynebacterium glutamicum* ATCC 13826 (prior genus and species: *Brevibacterium flavum*, or *Corynebacterium lactofermentum*) *Corynebacterium glutamicum* ATCC 14020 (prior genus and species: *Brevibacterium divaricatum*), *Corynebacterium glutamicum* ATCC 13869 (prior genus and species: *Brevibacterium lactofermentum*), *Corynebacterium herculis* ATCC 13868, *Corynebacterium lilium* ATCC 15990, *Corynebacterium melassecola* ATCC 17965, *Corynebacterium thermoaminogenes* FERM 9244, *Brevibacterium saccharolyticum* ATCC 4066, *Brevibacterium immariophilum* ATCC 14068, *Brevibacterium roseum* ATCC 13825, *Brevibacterium thiogenitalis* ATCC 19240, *Microbacterium ammoniaphilum* ATCC 15354, and the like.

(1) Preparation of Genome DNA of Coryneform Bacteria

Coryneform bacteria can be cultured by a conventional method.

Any of a natural medium and a synthetic medium can be used, so long as it is a medium suitable for efficient culturing of the microorganism, and it contains a carbon source, a nitrogen source, an inorganic salt, and the like which can be assimilated by the microorganism.

In *Corynebacterium glutamicum*, for example, a BY medium (7 g/l meat extract, 10 g/l peptone, 3 g/l sodium chloride, 5 g/l yeast extract, pH 7.2) containing 1% of glycine and the like can be used. The culturing is carried out at 25 to 35° C. overnight.

After the completion of the culture, the cells are recovered from the culture by centrifugation. The resulting cells are washed with a washing solution.

Examples of the washing solution include STE buffer (10.3% sucrose, 25 mmol/l Tris hydrochloride, 25 mmol/l ethylenediaminetetraacetic acid (hereinafter referred to as "EDTA"), pH 8.0), and the like.

Genome DNA can be obtained from the washed cells according to a conventional method for obtaining genome DNA, namely, lysing the cell wall of the cells using a lysozyme and a surfactant (SDS, etc.), eliminating proteins and the like using a phenol solution and a phenol/chloroform solution, and then precipitating the genome DNA with ethanol or the like. Specifically, the following method can be illustrated.

The washed cells are suspended in a washing solution containing 5 to 20 mg/l lysozyme. After shaking, 5 to 20% SDS is added to lyse the cells. In usual, shaking is gently performed at 25 to 40° C. for 30 minutes to 2 hours. After shaking, the suspension is maintained at 60 to 70° C. for 5 to 15 minutes for the lysis.

After the lysis, the suspension is cooled to ordinary temperature, and 5 to 20 ml of Tris-neutralized phenol is added thereto, followed by gently shaking at room temperature for 15 to 45 minutes.

After shaking, centrifugation (15,000×g, 20 minutes, 20° C.) is carried out to fractionate the aqueous layer.

After performing extraction with phenol/chloroform and extraction with chloroform (twice) in the same manner, 3 mol/l sodium acetate solution (pH 5.2) and isopropanol are added to the aqueous layer at ⅒ times volume and 2 times volume, of the aqueous layer, respectively, followed by gently stirring to precipitate the genome DNA.

The genome DNA is dissolved again in a buffer containing 0.01 to 0.04 mg/ml RNase. As an example of the buffer, TE buffer (10 mmol/l Tris hydrochloride, 1 mol/l EDTA, pH 8.0) can be used. After dissolving, the resultant solution is maintained at 25 to 40° C. for 20 to 50 minutes and then extracted successively with phenol, phenol/chloroform and chloroform as in the above case.

After the extraction, isopropanol precipitation is carried out and the resulting DNA precipitate is washed with 70% ethanol, followed by air drying, and then dissolved in TE buffer to obtain a genome DNA solution.

(2) Production of Shotgun Library

A method for produce a genome DNA library using the genome DNA of the coryneform bacteria prepared in the above (1) include a method described in *Molecular Cloning, A laboratory Manual*, Second Edition (1989) (hereinafter referred to as *"Molecular Cloning,* 2nd ed."). In particular, the following method can be exemplified to prepare a genome DNA library appropriately usable in determining the full nucleotide sequence by the shotgun method.

To 0.01 mg of the genome DNA of the coryneform bacteria prepared in the above (1) a buffer, such as TE buffer or the like, is added to give a total volume of 0.4 ml. Then, the genome DNA is digested into fragments of 1 to 10 kb with a sonicator (Yamato Powersonic Model 50). The treatment with the sonicator is performed at an output off 20 continuously for 5 seconds.

The resulting genome DNA fragments are blunt-ended using DNA blunting kit (manufactured by Takara Shuzo) or the like.

The blunt-ended genome fragments are fractionated by agarose gel or polyacrylamide gel electrophoresis and genome fragments of 1 to 2 kb are Cut out from the gel.

To the gel, 0.2 to 0.5 ml of a buffer for eluting DNA, such as MG elution buffer (0.5 mol/l ammonium acetate, 10 mmol/l magnesium acetate, 1 mmol/l EDTA, 0.1% SDS) or the like, is added, followed by shaking at 25 to 40° C. overnight to elute DNA.

The resulting DNA eluate is treated with phenol/chloroform and then precipitated with ethanol to obtain a genome library insert.

This insert is ligated into a suitable vector, such as pUC18 SmaI/BAP (manufactured by Amersham Pharmacia Biotech) or the like, using T4 ligase (manufactured by Takara Shuzo) or the like. The ligation can be carried out by allowing a mixture to stand at 10 to 20° C. for 20 to 50 hours.

The resulting ligation product is precipitated with ethanol and dissolved in 5 to 20 µl of TE buffer.

*Escherichia coli* is transformed in accordance with a conventional method using 0.5 to 2 µl of the ligation solution. Examples of the transformation method include the electroporation method using ELECTRO MAX DH10B (manufactured by Life Technologies) for *Escherichia coli*. The electroporation method can be carved out under the conditions as described in the manufacturer's instructions.

The transformed *Escherichia coli* is spread on a suitable selection medium containing agar, for example, LB plate medium containing 10 to 100 mg/l ampicillin (LB medium (10 g/l bactotrypton, 5 g/l yeast extract, 10 g/l sodium chloride, pH 7.0) containing 1.6% of agar) when pUC18 is used as the cloning vector, and cultured therein.

The transformant can be obtained as colonies formed on the plate medium. In this step, it is possible to select the transformant having the recombinant DNA containing the genome DNA as white colonies by adding X-gal and IPTG (isopropyl-β-thiogalactopyranoside) to the plate medium.

The transformant is allowed to stand for culturing in a 96-well titer plate to which 0.05 ml of the LB medium containing 0.1 mg/ml of ampicillin has been added in each well. The resulting culture can be used in an experiment of (4) described below. Also, the culture solution can be stored at −80° C. by adding 0.05 ml per well of the LB medium containing 20% glycerol to the culture solution, followed by mixing, and the stored culture solution can be used at any time.

(3) Production of Cosmid Library

The genome DNA (0.1 mg) of the coryneform bacteria prepared in the above (1) is partially digested with a restriction enzyme, such as Sau3AI or the like, and then ultracentrifuged (26,000 rpm, 18 hours, 20° C.) under a 10 to 40% sucrose density gradient using a 10% sucrose buffer (1 mol/l NaCl, 20 mmol/l Tris hydrochloride, 5 mmol/l EDTA, 10% sucrose, pH 8.0) and a 40% sucrose buffer (elevating the concentration of the 10% sucrose buffer to 40%).

After the centrifugation, the thus separated solution is fractionated into tubes in 1 ml per each tube. After confirming the DNA fragment size of each fraction by agarose gel electrophoresis, a fraction rich in DNA fragments of about 40 kb is precipitated with ethanol.

The resulting DNA fragment is ligated to a cosmid vector having a cohesive end which can be ligated to the fragment. When the genome DNA is partially digested with Sau3AI, the partially digested product can be ligated to, for example, the BamHI site of superCos1 (manufactured by Stratagene) in accordance with the manufacture's instructions.

The resulting ligation product is packaged using a packaging extract which can be prepared by a method described in *Molecular Cloning,* 2nd ed. and then used in transforming *Escherichia coli*. More specifically, the ligation product is packaged using, for example, a commercially available packaging extract, Gigapack III Gold Packaging Extract (manufactured by Stratagene) in accordance with the manufacture's instructions and then introduced into *Escherichia coli* XL-1-BlueMR (manufactured by Stratagene) or the like.

The thus transformed *Escherichia coli* is spread on an LB plate medium containing ampicillin, and cultured therein.

The transformant can be obtained as colonies formed on the plate medium.

The transformant is subjected to standing culture in a 96-well titer plate to which 0.05 ml of the LB medium containing 0.1 mg/ml ampicillin has been added.

The resulting culture can be employed in an experiment of (4) described below. Also, the culture solution can be stored at −80° C. by adding 0.05 ml per well of the LB medium containing 20% glycerol to the culture solution, followed by mixing, and the stored culture solution can be used at any time.

(4) Determination of Nucleotide Sequence (4-1) Preparation of Template

The full nucleotide sequence of genome DNA of coryneform bacteria can be determined basically according to the whole genome shotgun method (*Science,* 269: 496-512 (1995) ).

The template used in the whole genome shotgun method can be prepared by PCR using the library prepared in the above (2) (*DNA Research,* 5: 1-9 (1998)).

Specifically, the template can be prepared as follows.

The clone derived from the whole genome shotgun library is inoculated by using a replicator (manufactured by GENETIX) into each well of a 96-well plate to which 0.08 ml per well of the LB medium containing 0.1 mg/ml ampicillin has been added, followed by stationarily culturing at 37° C. overnight.

Next, the culture solution is transported, using a copy plate (manufactured by Tokken), into each well of a 96-well reaction plate (manufactured by PE Biosystems) to which 0.025 ml per well of a PCR reaction solution has been added using TaKaRa Ex Taq (manufactured by Takara Shuzo). Then, PCR is carried out in accordance with the protocol by Makino et al. (*DNA Research,* 5: 1-9 (1998)) using GeneAmp PCR System 9700 (manufactured by PE Biosystems) to amplify the inserted fragments.

The excessive primers and nucleotides are eliminated using a kit for purifying a PCR product, and the product is used as the template in the sequencing reaction.

It is also possible to determine the nucleotide sequence using a double-stranded DNA plasmid as a template.

The double-stranded DNA plasmid used as the template can be obtained by the following method.

The clone derived from the whole genome shotgun library is inoculated into each well of a 24- or 96-well plate to which 1.5 ml per well of a 2×YT medium (16 g/l bactotrypton, 10 g/l yeast extract, 5 g/l sodium chloride, pH 7.0) containing 0.05 mg/ml ampicillin has been added, followed by culturing under shaking at 37° C. overnight.

The double-stranded DNA plasmid can be prepared from the culture solution using an automatic plasmid preparing machine KURABO PI-50 (manufactured by Kurabo Industries), a multiscreen (manufactured by Millipore) or the like, according to each protocol.

To purify the plasmid, Biomek 2000 manufactured by Beckman Coulter and the like can be used.

The resulting purified double-stranded DNA plasmid is dissolved in water to give a concentration of about 0.1 mg/ml. Then, it can be used as the template in sequencing.

(4-2) Sequencing Reaction

The sequencing reaction can be carried out according to a commercially available sequence kit or the like. A specific method is exemplified below.

To 6 μl of a solution of ABI PRISM BigDye Terminator Cycle Sequencing, Ready Reaction Kit (manufactured by PE Biosystems), 1 to 2 pmol of an M13 regular direction primer (M13-21) or an M13 reverse direction primer (M13REV) (*DNA Research*, 5: 1-9 (1998)) and 50 to 200 ng of the template prepared in the above (4-1) (the PCR product or plasmid) to give 10 μl of a sequencing reaction solution.

A dye terminator sequencing reaction (35 to 55 cycles) is carried out using this reaction solution and Gene PCR System 9700 (manufactured by PE Biosystems) or the like. The cycle parameter can be determined in accordance with a commercially available kit, for example, the manufacture's instructions attached with ABI PRISM Big Dye Terminator Cycle Sequencing Ready Reaction Kit.

The sample can be purified using a commercially available product, such as Multi Screen HV plate (manufactured by Millipore) or the like, according to the manufacture's instructions.

The thus purified reaction product is precipitated with ethanol, dried and then used for the analysis. The dried reaction product can be stored in the dark at −30° C. and the stored reaction product can be used at any time.

The dried reaction product can be analyzed using a commercially available sequencer and an analyze according to the manufacture's instructions.

Examples of the commercially available sequencer include ABI PRISM 377 DNA Sequencer (manufactured by PE Biosystems) Example of the analyzer include ABI PRISM 3700 DNA Analyzer (manufactured by PE Biosystems).

(5) Assembly

A software, such as phred (The University of Washington) or the like, can be used as base call for use in analyzing the sequence information obtained in the above (4). A software, such as Cross_Match (The University of Washington) or SPS Cross_Match (manufactured by Southwest Parallel Software) or the like, can be used to mass the vector sequence information.

For the assembly, a software, such as phrap (The University of Washington), SPS phrap (manufactured by Southwest Parallel Software) or the like, can be used.

In the above, analysis and output of the results thereof, a computer such as UNIX, PC, Macintosh, and the like can be used.

Contig obtained by the assembly can be analyzed using a graphical editor such as consed (The University of Washington) or the like.

It is also possible to perform a series of the operations from the base call to the assembly in a lump using a script phredPhrap attached to the consed.

As used herein, software will be understood to also be referred to as a comparator.

(6) Determination of Nucleotide Sequence in Gap Part

Each of the cosmids in the cosmid library constructed in the above (3) is prepared in the same manner as in the preparation of the double-stranded DNA plasmid described in the above (4-1). The nucleotide sequence at the end of the insert fragment of the cosmid is determined using a commercially available kit, such as ABI PRISM BigDye Terminator Cycle Sequencing Ready Reaction Kit (manufactured by PE Biosystems) according to the manufacture's instructions.

About 800 cosmid clones are sequenced at both ends of the inserted fragment to detect a nucleotide sequence in the contig derived from the shotgun sequencing obtained in (5) which is coincident with the sequence. Thus, the chain linkage between respective cosmid clones and respective contigs are clarified, and mutual alignment is carried out. Furthermore, the results are compared with known physical maps to map the cosmids and the contigs. In case of *Corynebacterium glutamicum* ATCC 13032, a physical map of *Mol. Gen. Genet.*, 252: 255-265 (1996) can be used.

The sequence in the region which cannot be covered with the contigs (gap part) can be determined by the following method.

Clones containing sequences positioned at the ends of the contigs are selected. Among these, a clone wherein only one end of the inserted fragment has been determined is selected and the sequence at the opposite end of the inserted fragment is determined.

A shotgun library clone or a cosmid clone derived therefrom containing the sequences at the respective ends of the inserted fragments in the two contigs is identified and the full nucleotide sequence of the inserted fragment of the clone is determined.

According to this method, the nucleotide sequence of the gap part can be determined.

When no shotgun library clone or cosmid clone covering the gap part is available, primers complementary to the end sequences of the two different contigs are prepared and the DNA fragment in the gap part is amplified. Then, sequencing is performed by the primer walking method using the amplified DNA fragment as a template or by the shotgun method in which the sequence of a shotgun clone prepared from the amplified DNA fragment is determined. Thus, the nucleotide sequence of the above-described region can be determined.

In a region showing a low sequence accuracy, primers are synthesized using AUTOFINISH function and NAVIGATING function of consed (The University of Washington), and the sequence is determined by the primer walking method to improve the sequence accuracy.

Examples of the thus determined nucleotide sequence of the full genome include the full nucleotide sequence of genome of *Corynebacterium glutamicum* ATCC 13032 represented by SEQ ID NO:1.

(7) Determination of Nucleotide Sequence of Microorganism Genome DNA Using the Nucleotide Sequence Represented by SEQ ID NO:1

A nucleotide sequence of a polynucleotide having a homology of 80% or more with. the full nucleotide sequence of *Corynebacterium glutamicum* ATCC 13032 represented by SEQ ID NO:1 as determined above can also be determined using the nucleotide sequence represented by SEQ ID NO:1, and the polynucleotide having a nucleotide sequence having a homology of 80% or more with the nucleotide sequence represented by SEQ ID NO:1 of the present invention is within the scope of the present invention. The term "polynucleotide having a nucleotide sequence having a homology of 80% or more with the nucleotide sequence represented by SEQ ID NO:1 of the present invention" is a polynucleotide in which a full nucleotide sequence of the chromosome DNA can be determined using as a primer an oligonucleotide composed of continuous 5 to 50 nucleotides in the nucleotide sequence represented by SEQ ID NO:1, for example, according to PCR using the chromosome DNA as a template. A particularly preferred primer in determination of the full nucleotide sequence is an oligonucleotide having nucleotide sequences which are positioned at the interval of about 300 to 500 bp, and among such oligonucleotides, an oligonucleotide having a nucleotide sequence selected from DNAs encoding a protein relating to a main metabolic pathway is particularly preferred. The polynucleotide in which the full nucleotide sequence of the chromosome DNA can be determined using the oligonucleotide includes polynucleotides constituting a chromosome DNA derived from a microorganism belonging to coryneform bacteria. Such a polynucleotide is preferably a polynucleotide constituting chromosome DNA derived from a microorganism belonging to the genus *Corynebacterium*, more preferably a polynucleotide constituting a chromosome DNA of *Corynebacterium glutamicum*.

2. Identification of ORF (Open Reading Frame) and Expression Regulatory Fragment and Determination of the Function of ORF Based on the full nucleotide sequence data of the genome derived from coryneform bacteria determined in the above item 1, an ORF and an expression modulating fragment can be identified. Furthermore, the function of the thus determined ORF can be determined.

The ORF means a continuous region in the nucleotide sequence of mRNA which can be translated as an amino acid sequence to mature to a protein. A region of the DNA coding for the ORF of mRNA is also called ORF.

The expression modulating fragment (hereinafter referred to as "EMF") is used herein to define a series of polynucleotide fragments which modulate the expression of the ORF or another sequence ligated operatably thereto. The expression "modulate the expression of a sequence ligated operatably" is used herein to refer to changes in the expression of a sequence due to the presence of the EMF. Examples of the EMF include a promoter, an operator, an enhancer, a silencer, a ribosome-binding sequence, a transcriptional termination sequence, and the like. In coryneform bacteria, an EMF is usually present in an intergenic segment (a fragment positioned between two genes; about 10 to 200 nucleotides in length). Accordingly, an EMF is frequently present in an intergenic segment of 10 nucleotides or longer. It is also possible to determine or discover the presence of an EMF by using known EMF sequences as a target sequence or a target structural motif (or a target motif) using an appropriate software or comparator, such as FASTA (*Proc. Natl. Acad. Sci. USA,* 85: 2444-48 (1988)), BLAST (*J. Mol. Biol.,* 215: 403-410 (1990)) or the like. Also, it can be identified and evaluated using a known EMF-capturing vector (for example, pKK232-8; manufactured by Amersham Pharmacia Biotech).

The term "target sequence" is used herein to refer to a nucleotide sequence composed of 6 or more nucleotides, an amino acid sequence composed of 2 or more amino acids, or a nucleotide sequence encoding this amino acid sequence composed of 2 or more amino acids. A longer target sequence appears at random in a data base at the lower possibility. The target sequence is preferably about 10 to 100 amino acid residues or about 30 to 300 nucleotide residues.

The term "target structural motif" or "target motif" is used herein to refer to a sequence or a combination of sequences selected optionally and reasonably. Such a motif is selected on the basis of the three-dimensional structure formed by the folding of a polypeptide by means known to one of ordinary skill in the art. Various motives are known.

Examples of the target motif of a polypeptide include, but are not limited to, an enzyme activity site, a protein-protein interaction site, a signal sequence, and the like. Examples of the target motif of a nucleic acid include a promoter sequence, a transcriptional regulatory factor binding sequence, a hair pin structure, and the like.

Examples of highly useful EMF include a high-expression promoter, an inducible-expression promoter, and the like. Such an EMF can be obtained by positionally determining the nucleotide sequence of a gene which is known or expected as achieving high expression (for example, ribosomal RNA gene: GenBank Accession No. M16175 or Z46753) or a gene showing a desired induction pattern (for example, isocitrate lyase gene induced by acetic acid: Japanese Published Unexamined Patent Application No. 56782/93) via the alignment with the full genome nucleotide sequence determined in the above item 1, and isolating the genome fragment in the upstream part (usually 200 to 500 nucleotides from the translation initiation site). It is also possible to obtain a highly useful EMF by selecting an EMF showing a high expression efficiency or a desired induction pattern from among promoters captured by the EMF-capturing vector as described above.

The ORF can be identified by extracting characteristics common to individual ORFs, constructing a general model based on these characteristics, and measuring the conformity of the subject sequence with the model. In the identification, a software, such as GeneMark (*Nuc. Acids. Res.,* 22: 4756-67 (1994): manufactured by GenePro)), GeneMark.hmm (manufactured by GenePro), GeneHacker (*Protein, Nucleic Acid and Enzyme,* 42: 3001-07 (1997)), Glimmer (*Nuc. Acids. Res.,* 26: 544-548 (1998): manufactured by The Institute of Genomic Research), or the like, can be used. In using the software, the default (initial setting) parameters are usually used, though the parameters can be optionally changed.

In the above-described comparisons, a computer, such as UNIX, PC, Macintosh, or the like, can be used.

Examples of the ORF determined by the method of the present invention include ORFs having the nucleotide sequences represented by SEQ ID NOS:2 to 3501 present in the genome of *Corynebacterium glutamicum* as represented by SEQ ID NO:1. In these ORFs, polypeptides having the amino acid sequences represented by SEQ ID NOS:3502 to 7001 are encoded.

The function of an ORF can be determined by comparing the identified amino acid sequence of the ORF with known homologous sequences using a homology searching software or comparator, such as BLAST, FAST, Smith & Waterman (*Meth. Enzym.*, 164: 765 (1988)) or the like on an amino acid data base, such as Swith-Prot, PIR, GenBank-nr-aa, GenPept constituted by protein-encoding domains derived from GenBank data base, OWL or the like.

Furthermore, by the homology searching, the identity and similarity with the amino acid sequences of known proteins can also be analyzed.

With respect of the term "identity" used herein, where two polypeptides each having 10 amino acids are different in the positions of 3 amino acids, these polypeptides have an identity of 70% with each other. In case wherein one of the different 3 amino acids is analogue (for example, leucine and isoleucine), these polypeptides have a similarity of 80%.

As a specific example, Table 1 shows the registration numbers in known data bases of sequences which are judged as having the highest similarity with the nucleotide sequence of the ORF derived from *Corynebacterium glutamicum* ATCC 13032, genes of these sequences, functions of these genes, and identities thereof compared with known amino acid translation sequences.

Thus, a great number of novel genes derived from coryneform bacteria can be identified by determining the full nucleotide sequence of the genome derived from coryneform bacterium by the means of the present invention. Moreover, the function of the proteins encoded by these genes can be determined. Since coryneform bacteria are industrially highly useful microorganisms, many of the identified genes are industrially useful.

Moreover, the characteristics of respective microorganisms can be clarified by classifying the functions thus determined. As a result, valuable information in breeding is obtained.

Furthermore, from the ORF information derived from coryneform bacteria, the ORF corresponding to the microorganism is prepared and obtained according to the general method as disclosed in *Molecular Cloning*, 2nd ed. or the like. Specifically, an oligonucleotide having a nucleotide sequence adjacent to the ORF is synthesized, and the ORF can be isolated and obtained using the oligonucleotide as a primer and a chromosome DNA derived from coryneform bacteria as a template according to the general PCR cloning technique. Thus obtained ORF sequences include polynucleotides comprising the nucleotide sequence represented by any one of SEQ ID NOS:2 to 3501.

The ORF or primer can be prepared using a polypeptide synthesizer based on the above sequence information.

Examples of the polynucleotide of the present invention include a polynucleotide containing the nucleotide sequence of the ORF obtained in the above, and a polynucleotide which hybridizes with the polynucleotide under stringent conditions.

The polynucleotide of the present invention can be a single-stranded DNA, a double-stranded DNA and a single-stranded RNA, though it is not limited thereto.

The polynucleotide which hybridizes with the polynucleotide containing the nucleotide sequence of the ORF obtained in the above under stringent conditions includes a degenerated mutant of the ORF. A degenerated mutant is a polynucleotide fragment having a nucleotide sequence which is different from the sequence of the ORF of the present invention which encodes the same amino acid sequence by degeneracy of a gene code.

Specific examples include a polynucleotide comprising the nucleotide sequence represented by any one of SEQ ID NOS:2 to 3431, and a polynucleotide which hybridizes with the polynucleotide under stringent conditions.

A polynucleotide which hybridizes under stringent conditions is a polynucleotide obtained by colony hybridization, plaque hybridization, Southern blot hybridization or the like using, as a probe, the polynucleotide having the nucleotide sequence of the ORF identified in the above. Specific examples include a polynucleotide which can be identified by carrying out hybridization at 65° C. in the presence of 0.7-1.0 M NaCl using a filter on which a polynucleotide prepared from colonies or plaques is immobilized, and then washing the filter with 0.1× to 2×SSC solution (the composition of 1×SSC contains 150 mM sodium chloride and 15 mM sodium citrate) at 65° C.

The hybridization can be carried out in accordance with known methods described in, for example, *Molecular Cloning*, 2nd ed., *Current Protocols in Molecular Biology, DNA Cloning 1: Core Techniques, A Practical Approach*, Second Edition, Oxford University (1995) or the like. Specific examples of the polynucleotide which can be hybridized include a DNA having a homology of 60% or more, preferably 80% or more, and particularly preferably 95% or more, with the nucleotide sequence represented by any one of SEQ ID NO:2 to 3431 when calculated using default (initial setting) parameters of a homology searching software, such as BLAST, FASTA, Smith-Waterman or the like.

Also, the polynucleotide of the present invention includes a polynucleotide encoding a polypeptide comprising the amino acid sequence represented by any one of SEQ ID NOS:3502 to 6931 and a polynucleotide which hybridizes with the polynucleotide under stringent conditions.

Furthermore, the polynucleotide of the present invention includes a polynucleotide which is present in the 5' upstream or 3' downstream region of a polynucleotide comprising the nucleotide sequence of any one of SEQ ID NOS:2 to 3431 in a polynucleotide comprising the nucleotide sequence represented by SEQ ID NO:1, and has an activity of regulating an, expression of a polypeptide encoded by the polynucleotide. Specific examples of the polynucleotide having an activity of regulating an expression of a polypeptide encoded by the polynucleotide includes a polynucleotide encoding the above described EMF, such as a promoter, an operator, an enhancer, a silencer, a ribosome-binding sequence, a transcriptional termination sequence, and the like.

The primer used for obtaining the ORF according to the above PCR cloning technique includes an oligonucleotide comprising a sequence which is the same as a sequence of 10 to 200 continuous nucleotides in the nucleotide sequence of the ORF and an adjacent region or an oligonucleotide comprising a sequence which is complementary to the oligonucleotide. Specific examples include an oligonucleotide comprising a sequence which is the same as a sequence of 10 to 200 continuous nucleotides of the nucleotide sequence represented by any one of SEQ ID NOS:1 to 3431, and an oligonucleotide comprising a sequence complementary to the oligonucleotide comprising a sequence of at least 10 to 20 continuous nucleotide of any one of SEQ ID NOS:1 to 3431. When the primers are used as a sense primer and an antisense primer, the above-described oligonucleotides in which melting temperature ($T_m$) and the number of nucleotides are not significantly different from each other are preferred.

The oligonucleotide of the present invention includes an oligonucleotide comprising a sequence which is the same as 10 to 200 continuous nucleotides of the nucleotide sequence represented by any one of SEQ ID NOS:1 to 3431 or an oligonucleotide comprising a sequence complementary to the oligonucleotide.

Also, analogues of these oligonucleotides (hereinafter also referred to as "analogous oligonucleotides") are also provided by the present invention and are useful in the methods described herein.

Examples of the analogous oligonucleotides include analogous oligonucleotides in which a phosphodiester bond in an oligonucleotide is converted to a phosphorothioate bond, analogous oligonucleotides in which a phosphodiester bond in an oligonucleotide is converted to an N3'-P5' phosphoamidate bond, analogous oligonucleotides in which ribose and a phosphodiester bond in an oligonucleotide is converted to a peptide nucleic acid bond, analogous oligonucleotides in which uracil in an oligonucleotide is replaced with C-5 propynyluracil, analogous oligonucleotides in which uracil in an oligonucleotide is replaced with C-5 thiazoluracil, analogous oligonucleotides in which cytosine in an oligonucleotide is replaced with C-5 propynylcytosine, analogous oligonucleotides in which cytosine in an oligonucleotide is replaced with phenoxazine-modified cytosine, analogous oligonucleotides in which ribose in an oligonucleotide is replaced with 2'-O-propylribose, analogous oligonucleotides in which ribose in an oligonucleotide is replaced with 2'-methoxyethoxyribose, and the like (*Cell Engineering*, 16: 1463 (1997)).

The above oligonucleotides and analogous oligonucleotides of the present invention can be used as probes for hybridization and antisense nucleic acids described below in addition to as primers.

Examples of a primer for the antisense nucleic acid techniques known in the art include an oligonucleotide which hybridizes the oligonucleotide of the present invention under stringent conditions and has an activity regulating expression of the polypeptide encoded by the polynucleotide, in addition to the above oligonucleotide.

3. Determination of Isozymes

Many mutants of coryneform bacteria which are useful in th production of useful substances, such as amino acids, nucleic acids, vitamins, saccharides, organic acids, and the like, are obtained by the present invention.

However, since the gene sequence data of the microorganism has been, to date, insufficient, useful mutants have been obtained by mutagenic techniques using a mutagen, such as nitrosoguanidine (NTG) or the like.

Although genes can be mutated randomly by the mutagenic method using the above-described mutagen, all genes encoding respective isozymes having similar properties relating to the metabolism of intermediates cannot be mutated. In the mutagenic method using a mutagen, genes are mutated randomly. Accordingly, harmful mutations worsening culture characteristics, such as delay in growth, accelerated foaming, and the like, might be imparted at a great frequency, in a random manner.

However, if gene sequence information is available, such as is provided by the present invention, it is possible to mutate all of the genes encoding target isozymes. In this case, harmful mutations may be avoided and the target mutation can be incorporated.

Namely, an accurate number and sequence information of the target isozymes in coryneform bacteria can be obtained based on the ORF data obtained in the above item 2. By using the sequence information, all of the target isozyme genes can be mutated into genes having the desired properties by, for example, the site-specific mutagenesis method described in *Molecular Cloning*, 2nd ed. to obtain useful mutants having elevated productivity of useful substances.

4. Clarification or Determination of Biosynthesis Pathway and Signal Transmission Pathway Attempts have been made to elucidate biosynthesis pathways and signal transmission pathways in a number of organisms, and many findings have been reported. However, there are many unknown aspects of coryneform bacteria since a number of genes have not been identified so far.

These unknown points can be clarified by the following method.

The functional information of ORF derived from coryneform bacteria as identified by the method of above item 2 is arranged. The term "arranged" means that the ORF is classified based on the biosynthesis pathway of a substance or the signal transmission pathway to which the ORF belongs using known information according to the functional information. Next, the arranged ORF sequence information is compared with enzymes on the biosynthesis pathways or signal transmission pathways of other known organisms. The resulting information is combined with known data on coryneform bacteria. Thus, the biosynthesis pathways and signal transmission pathways in coryneform bacteria, which have been unknown so far, can be determined.

As a result that these pathways which have been unknown or unclear hitherto are clarified, a useful mutant for producing a target useful substance can be efficiently obtained.

When the thus clarified pathway is judged as important in the synthesis of a useful product, a useful mutant can be obtained by selecting a mutant wherein this pathway has been strengthened. Also, when the thus clarified pathway is judged as not important in the biosynthesis of the target useful product, a useful mutant can be obtained by selecting a mutant wherein the utilization frequency of this pathway is lowered.

5. Clarification or Determination of Useful Mutation Point

Many useful mutants of coryneform bacteria which are suitable for the production of useful substances, such as amino acids, nucleic acids, vitamins, saccharides, organic acids, and the like, have been obtained. However, it is hardly known which mutation point is imparted to a gene to improve the productivity.

However, mutation points contained in production strains can be identified by comparing desired sequences of the genome. DNA of the production strains obtained from coryneform bacteria by the mutagenic technique with the nucleotide sequences of the corresponding genome DNA and ORF derived from coryneform bacteria determined by the methods of the above items 1 and 2 and analyzing them Moreover, effective mutation points contributing to the production can be easily specified from among these mutation points on the basis of known information relating to the metabolic pathways, the metabolic regulatory mechanisms, the structure activity correlation of enzymes, and the like.

When any efficient mutation can be hardly specified based on known data, the mutation points thus identified can be introduced into a wild strain of coryneform bacteria or a production strain free of the mutation. Then, it is examined whether or not any positive effect can be achieved on the production.

For example, by comparing the nucleotide sequence of homoserine dehydrogenase gene hom of a lysine-producing B-6-strain of *Corynebacterium glutamicum* (*Appl. Microbiol. Biotechnol.*, 32: 269-273 (1989)) with the nucleotide sequence corresponding to the genome of *Corynebacterium glutamicum* ATCC 13032 according to the present invention, a mutation of amino acid replacement in which valine at the 59-position is replaced with alanine (Val59Ala) was identified. A strain obtained by introducing this mutation into the ATCC 13032 strain by the gene replacement method can produce lysine, which indicates that this mutation is an effective mutation contributing to the production of lysine.

Similarly, by comparing the nucleotide sequence of pyruvate carboxylase gene pyc of the B-6 strain with the nucleotide sequence corresponding to the ATCC 13032 genome, a mutation of amino acid replacement in which proline at the 458-position was replaced with serine (Pro458Ser) was identified. A strain obtained by introducing this mutation into a lysine-producing strain of No. 58 (FERM BP-7134) of Corynebacterium glutamicum free of this mutation shows an improved lysine productivity in comparison with the No. 58 strain, which indicates that this mutation is an effective mutation contributing to the production of lysine.

In addition, a mutation Ala213Thr in glucose-6-phosphate dehydrogenase was specified as an effective mutation relating to the production of lysine by detecting glucose-6-phosphate dehydrogenase gene zwf of the B-6 strain.

Furthermore, the lysine-productivity of Corynebacterium glutamicum was improved by replacing the base at the 932-position of aspartokinase gene lysC of the Corynebacterium glutamicum ATCC 13032 genome with cytosine to thereby replace threonine at the 311-position by isoleucine, which indicates that this mutation is an effective mutation contributing to the production of lysine.

Also, as another method to examine whether or not the identified mutation point is an effective mutation, there is a method in which the mutation possessed by the lysine-producing strain is returned to the sequence of a wild type strain by the gene replacement method and whether or not it has a negative influence on the lysine productivity. For example, when the amino acid replacement mutation Val59Ala possessed by hom of the lysine-producing B-6 strain was returned to a wild type amino acid sequence, the lysine productivity was lowered in comparison with the B-6 strain. Thus, it was found that this mutation is an effective mutation contributing to the production of lysine.

Effective mutation points can be more efficiently and comprehensively extracted by combining, if needed, the DNA array analysis or proteome analysis described below.

6. Method of Breeding Industrially Advantageous Production Strain

It has been a general practice to construct production strains, which are used industrially in the fermentation production of the target useful substances, such as amino acids, nucleic acids, vitamins, saccharides, organic acids, and the like, by repeating mutagenesis and breeding based on random mutagenesis using mutagens, such as NTG or the like, and screening.

In recent years, many examples of improved production strains have been made through the use of recombinant DNA techniques. In breeding, however, most of the parent production strains to be improved are mutants obtained by a conventional mutagenic procedure (W. Leuchtenberger, Amino Acids—Technical Production and Use. In: Roehr (ed) Biotechnology, second edition, vol. 6, products of primary metabolism. VCH Verlagsgesellschaft mbH, Weinheim, P 465 (1996)).

Although mutagenesis methods have largely contributed to the progress of the fermentation industry, they suffer from a serious problem of multiple, random introduction of mutations into every part of the chromosome. Since many mutations are accumulated in a single chromosome each time a strain is improved, a production strain obtained by the random mutation and selecting is generally inferior in properties (for example, showing poor growth, delayed consumption of saccharides, and poor resistance to stresses such as temperature and oxygen) to a wild type strain, which brings about troubles such as failing to establish a sufficiently elevated productivity, being frequently contaminated with miscellaneous bacteria, requiring troublesome procedures in culture maintenance, and the like, and, in its turn, elevating the production cost in practice. In addition, the improvement in the productivity is based on random mutations and thus the mechanism thereof is unclear. Therefore, it is very difficult to plan a rational breeding strategy for the subsequent improvement in the productivity.

According to the present invention, effective mutation points contributing to the production can be efficiently specified from among many mutation points accumulated in the chromosome of a production strain which has been bred from coryneform bacteria and, therefore, a novel breeding method of assembling these effective mutations in the coryneform bacteria can be established. Thus, a useful production strain can be reconstructed. It is also possible to construct a useful production strain from a wild type strain.

Specifically, a useful mutant can be constructed in the following manner.

One of the mutation points is incorporated into a wild type strain of coryneform bacteria. Then, it is examined whether or not a positive effect is established on the production. When a positive effect is obtained, the mutation point is saved. When no effect is obtained, the mutation point is removed. Subsequently, only a strain having the effective mutation point is used as the parent strain, and the same procedure is repeated. In general, the effectiveness of a mutation positioned upstream cannot be clearly evaluated in some cases when there is a rate-determining point in the downstream of a biosynthesis pathway. It is therefore preferred to successively evaluate mutation points upward from downstream.

By reconstituting effective mutations by the method as described above in a wild type strain or a strain which has a high growth speed or the same ability to consume saccharides as the wild type strain, it is possible to construct an industrially advantageous strain which is free of troubles in the previous methods as described above and to conduct fermentation production using such strains within a short time or at a higher temperature.

For example, a lysine-producing mutant B-6 (Appl. Microbiol. Biotechnol., 32: 262-273 (1989)), which is obtained by multiple rounds of random mutagenesis from a wild type strain Corynebacterium glutamicum ATCC 13032, enables lysine fermentation to be performed at a temperature between 30 and 34° C. but shows lowered growth and lysine productivity at a temperature exceeding 34° C. Therefore, the fermentation temperature should be maintained at 34° C. or lower. In contrast thereto, the production strain described in the above item 5, which is obtained by reconstituting effective mutations relating to lysine production, can achieve a productivity at 40 to 42° C. equal or superior to the result obtained by culturing at 30 to 34° C. Therefore, this strain is industrially advantageous since it can save the load of cooling during the fermentation.

When culture should be carried out at a high temperature exceeding 43° C., a production strain capable of conducting fermentation production at a high temperature exceeding 43° C. can be obtained by reconstituting useful mutations in a, microorganism belonging to the genus Corynebacterium which can grow at high temperature exceeding 43° C. Examples of the microorganism capable of growing at a high temperature exceeding 43° C. include *Corynebacterium thermoaminogenes*, such as *Corynebacterium thermoaminogenes* FERM 9244, FERM 9245, FERM 9246 and FERM 9247.

A strain having a further improved productivity of the target product can be obtained using the thus reconstructed strain as the parent strain and further breeding it using the conventional mutagenesis method, the gene amplification method, the gene replacement method using the recombinant DNA technique, the transduction method or the cell fusion method. Accordingly, the microorganism of the present invention includes, but is not limited to, a mutant, a cell fusion strain, a transformant, a transductant or a recombinant strain constructed by using recombinant DNA techniques, so long as it is a producing strain obtained via the step of accumulating at least two effective mutations in a coryneform bacteria in the course of breeding.

When a mutation point judged as being harmful to the growth or production is specified, on the other hand, it is examined whether or not the producing strain used at present contains the mutation point. When it has the mutation, it can be returned to the wild type gene and thus a further useful production strain can be bred.

The breeding method as described above is applicable to microorganisms, other than coryneform bacteria, which have industrially advantageous properties (for example, microorganisms capable of quickly utilizing less expensive carbon sources, microorganisms capable of growing at higher temperatures).

7. Production and Utilization of Polynucleotide Array (1) Production of Polynucleotide Array A polynucleotide array can be produced using the polynucleotide or oligonucleotide of the present invention obtained in the above items 1 and 2.

Examples include a polynucleotide array comprising a solid support to which at least one of a polynucleotide comprising the nucleotide sequence represented by SEQ ID NOS:2 to 3501, a polynucleotide which hybridizes with the polynucleotide under stringent conditions, and a polynucleotide comprising 10 to 200 continuous nucleotides in the nucleotide sequence of the polynucleotide is adhered; and a polynucleotide array comprising a solid support to which at least one of a polynucleotide encoding a polypeptide comprising the amino acid sequence represented by any one of SEQ ID NOS:3502 to 7001, a polynucleotide which hybridizes with the polynucleotide under stringent conditions, and a polynucleotide comprising 10 to 200 continuous bases in the nucleotide sequences of the polynucleotides is adhered.

Polynucleotide arrays of the present invention include substrates known in the art, such as a DNA chip, a DNA microarray and a DNA macroarray, and the like, and comprises a solid support and plural polynucleotides or fragments thereof which are adhered to the surface of the solid support.

Examples of the solid support include a glass plate, a nylon membrane, and the like.

The polynucleotides or fragments thereof adhered to the surface of the solid support can be adhered to the surface of the solid support using the general technique for preparing arrays. Namely, a method in which they are adhered to a chemically surface-treated solid support, for example, to which a polycation such as polylysine or the like has been adhered (*Nat. Genet.*, 21: 15-19 (1999)). The chemically surface-treated supports are commercially available and the commercially available solid product can be used, as the solid support of the polynucleotide array according to the present invention.

As the polynucleotides or oligonucleotides adhered to the solid support, the polynucleotides and oligonucleotides of the present invention obtained in the above items 1 and 2 can be used.

The analysis described below can be efficiently performed by adhering the polynucleotides or oligonucleotides to the solid support at a high density, though a high fixation density is not always necessary.

Apparatus for achieving a high fixation density, such as an arrayer robot or the like, is commercially available from Takara Shuzo (GMS417 Arrayer), and the commercially available product can be used.

Also, the oligonucleotides of the present invention can be synthesized directly on the solid support by the photolithography method or the like (*Nat. Genet.*, 21: 20-24 (1999)). In this method, a linker having a protective group which can be removed by light irradiation is first adhered to a solid support, such as a slide glass or the like. Then, it is irradiated with light through a mask (a photolithograph mask) permeating light exclusively at a definite part of the adhesion part. Next, an oligonucleotide having a protective group which can be removed by light irradiation is added to the part. Thus, a ligation reaction with the nucleotide arises exclusively at the irradiated part. By repeating this procedure, oligonucleotides, each having a desired sequence, different from each other can be synthesized in respective parts. Usually, the oligonucleotides to be synthesized have a length of 10 to 30 nucleotides.

(2) Use of Polynucleotide Array

The following procedures (a) and (b) can be carried out using the polynucleotide array prepared in the above (1).

(a) Identification of Mutation Point of Coryneform Bacterium Mutant and Analysis of Expression Amount and Expression Profile of Gene Encoded by Genome By subjecting a gene derived from a mutant of coryneform bacteria or an examined gene to the following steps (i) to (iv), the mutation point of the gene can be identified or the expression amount and expression profile of the gene can be analyzed:

(i) producing a polynucleotide array by the method of the above (1);
(ii) incubating polynucleotides immobilized on the polynucleotide array together with the labeled gene derived from a mutant of the coryneform bacterium using the polynucleotide array produced in the above (i) under hybridization conditions;
(iii) detecting the hybridization; and
(iv) analyzing the hybridization data.

The gene derived from a mutant of coryneform bacteria or the examined gene include a gene relating to biosynthesis of at least one selected from amino acids, nucleic acids, vitamins, saccharides, organic acids, and analogues thereof.

The method will be described in detail.

A single nucleotide polymorphism (SNP) in a human region of 2,300 kb has been identified using polynucleotide arrays (*Science*, 280: 1077-82 (1998)). In accordance with the method of identifying SNP and methods described in *Science*, 278: 680-686 (1997); *Proc. Natl. Acad. Sci. USA*, 96: 12833-38 (1999); *Science*, 284: 1520-23 (1999), and the like using the polynucleotide array produced in the above (1) and a nucleic acid molecule (DNA, RNA) derived from coryneform bacteria in the method of the hybridization, a mutation point of a useful mutant, which is useful in producing an amino acid, a nucleic acid, a vitamin, a saccharide, an organic acid, or the like can be identified and the gene expression amount and the expression profile thereof can be analyzed.

The nucleic acid molecule (DNA, RNA) derived from the coryneform bacteria can be obtained according to the general method described in *Molecular Cloning*, 2nd ed. or the like. mRNA derived from *Corynebacterium glutamicum* can also be obtained by the method of Bormann et al. (*Molecular Microbiology*, 6: 317-326 (1992)) or the like.

Although ribosomal RNA (rRNA) is usually obtained in large excess in addition to the target mRNA, the analysis is not seriously disturbed thereby.

The resulting nucleic acid molecule derived from coryneform bacteria is labeled. Labeling can be carried out according to a method using a fluorescent dye, a method using a radioisotope or the like.

Specific examples include a labeling method in which psoralen-biotin is crosslinked with RNA extracted from a microorganism and, after hybridization reaction, a fluorescent dye having streptoavidin bound thereto is bound to the biotin moiety (*Nat. Biotechnol.*, 16: 45-48 (1998)); a labeling method in which a reverse transcription reaction is carried out using RNA extracted from a microorganism as a template and random primers as primers, and dUTP having a fluorescent dye (for example, Cy3, Cy5) (manufactured by Amersham Pharmacia Biotech) is incorporated into cDNA (*Proc. Natl. Acad. Sci. USA*, 96: 12833-38 (1999)); and the like.

The labeling specificity can be improved by replacing the random primers by sequences complementary to the 3'-end of ORF (*J. Bacteriol.*, 181: 6425-40 (1999)).

In the hybridization method, the hybridization and subsequent washing can be carried out by the general method (*Nat. Biotechnol.*, 14: 1675-80 (1996), or the like).

Subsequently, the hybridization intensity is measured depending on the hybridization amount of the nucleic acid molecule used in the labeling. Thus, the mutation point can be identified and the expression amount of the gene can be calculated.

The hybridization intensity can be measured by visualizing the fluorescent signal, radioactivity, luminescence dose, and the like, using a laser confocal microscope, a CCD camera, a radiation imaging device (for example, STORM manufactured by Amersham Pharmacia Biotech), and the like, and then quantifying the thus visualized data.

A polynucleotide array on a solid support can also be analyzed and quantified using a commercially available apparatus, such as GMS418 Array Scanner (manufactured by Takara Shuzo) or the like.

The gene expression amount can be analyzed using a commercially available software (for example, ImaGene manufactured by Takara Shuzo; Array Gauge manufactured by Fuji Photo Film; ImageQuant manufactured by Amersham Pharmacia Biotech, or the like).

A fluctuation in the expression amount of a specific gene can be monitored using a nucleic acid molecule obtained in the time course of culture as the nucleic acid molecule derived from coryneform bacteria. The culture conditions can be optimized by analyzing the fluctuation.

The expression profile of the microorganism at the total gene level (namely, which genes among a great number of genes encoded by the genome have been expressed and the expression ratio thereof) can be determined using a nucleic acid molecule having the sequences of many genes determined from the full genome sequence of the microorganism. Thus, the expression amount of the genes determined by the full genome sequence can be analyzed and, in its turn, the biological conditions of the microorganism can be recognized as the expression pattern at the full gene level.

(b) Confirmation of the Presence of Gene Homologous to Examined Gene in Coryneform Bacteria Whether or not a gene homologous to the examined gene, which is present in an organism other than coryneform bacteria, is present in coryneform bacteria can be detected using the polynucleotide array prepared in the above (1).

This detection can be carried out by a method in which an examined gene which is present in an organism other than coryneform bacteria is used instead of the nucleic acid molecule derived from coryneform bacteria used in the above identification/analysis method of (1).

8. Recording Medium Storing Full Genome Nucleotide Sequence and ORF Data and Being Readable by a Computer and Methods for Using the Same The term "recording medium or storage device which is readable by a computer" means a recording medium or storage medium which can be directly readout and accessed with a computer. Examples include magnetic recording media, such as a floppy disk, a hard disk, a magnetic tape, and the like; optical recording media, such as CD-ROM, CD-R, CD-RW, DVD-ROM, DVD-RAM, DVD-RW, and the like; electric recording media, such as RAM, ROM, and the like; and hybrids in these categories (for example, magnetic/optical recording media, such as MO and the like).

Instruments for recording or inputting in or on the recording medium or instruments or devices for reading out the information in the recording medium can be appropriately selected, depending on the type of the recording medium and the access device utilized. Also, various data processing programs, software, comparator and formats are used for recording and utilizing the polynucleotide sequence information or the like of the present invention in the recording medium. The information can be expressed in the form of a binary file, a text file or an ASCII file formatted with commercially available software, for example. Moreover, software for accessing the sequence information is available and known to one of ordinary skill in the art.

Examples of the information to be recorded in the above-described medium include the full genome nucleotide sequence information of coryneform bacteria as obtained in the above item 2, the nucleotide sequence information of ORF, the amino acid sequence information encoded by the ORF, and the functional information of polynucleotides coding for the amino acid sequences.

The recording medium or storage device which is readable by a computer according to the present invention refers to a medium in which the information of the present invention has been recorded. Examples include recording media or storage devices which are readable by a computer storing the nucleotide sequence information represented by SEQ ID NOS:1 to 3501, the amino acid sequence information represented by SEQ ID NOS:3502 to 7001, the functional information of the nucleotide sequences represented by SEQ ID NOS:1 to 3501, the functional information of the amino acid sequences represented by SEQ ID NOS:3502 to 7001, and the information listed in Table 1 below and the like.

9. System Based on a Computer Using the Recording Medium of the Present Invention which is Readable by a Computer The term "system based on a computer" as used herein refers a system composed of hardware device(s) software device(s), and data recording device(s) which are used for analyzing the data recorded in the recording medium of the present invention which is readable by a computer.

The hardware device(s) are, for example, composed of an input unit, a data recording unit, a central processing unit and an output unit collectively or individually.

By the software device(s), the data recorded in the recording medium of the present invention are searched or analyzed using the recorded data and the hardware device(s) as described herein. Specifically, the software device(s) contain at least one program which acts on or with the system in order to screen, analyze or compare biologically meaningful structures or information from the nucleotide sequences, amino acid sequences and the like recorded in the recording medium according to the present invention.

Examples of the software device(s) for identifying ORF and EMF domains include GeneMark (*Nuc. Acids. Res.*, 22: 4756-67 (1994)), GeneHacker (*Protein, Nucleic Acid and Enzyme*, 42: 3001-07 (1997)), Glimmer (The Institute of Genomic Research; *Nuc. Acids. Res.*, 26: 544-548 (1998)) and the like. In the process of using such a software device, the default (initial setting) parameters are usually used, although the parameters can be changed, if necessary, in a manner known to one of ordinary skill in the art.

Examples of the software device(s) for identifying a genome domain or a polypeptide domain analogous to the target sequence or the target structural motif (homology searching) include FASTA, BLAST, Smith-Waterman, GenetyxMac (manufactured by Software Development), GCG Package (manufactured by Genetic Computer Group), GenCore (manufactured by Compugen), and the like. In the process of using such a software device, the default (initial setting) parameters are usually used, although the parameters can be changed, if necessary, in a manner known to one of ordinary skill in the art.

Such a recording medium storing the full genome sequence data is useful in preparing a polynucleotide array by which the expression amount of a gene encoded by the genome DNA of coryneform bacteria and the expression profile at the total gene level of the microorganism, namely, which genes among many genes encoded by the genome have been expressed and the expression ratio thereof, can be determined.

The data recording device(s) provided by the present invention are, for example, memory device(s) for recording the data recorded in the recording medium of the present invention and target sequence or target structural motif data, or the like, and a memory accessing device(s) for accessing the same.

Namely, the system based on a computer according to the present invention comprises the following:
(i) a user input device that inputs the information stored in the recording medium of the present invention, and target sequence or target structure motif information;
(ii) a data storage device for at least temporarily storing the input information;
(iii) a comparator that compares the information stored in the recording medium of the present invention with the target sequence or target structure motif information, recorded by the data storing device of (ii) for screening and analyzing nucleotide sequence information which is coincident with or analogous to the target sequence or target structure motif information; and
(iv) an output device that shows a screening or analyzing result obtained by the comparator.

This system is usable in the methods in items 2 to 5 as described above for searching and analyzing the ORF and EMF domains, target sequence, target structural motif, etc.

of a coryneform bacterium, searching homologs, searching and analyzing isozymes, determining the biosynthesis pathway and the signal transmission pathway, and identifying spots which have been found in the proteome analysis. The term "homologs" as used herein includes both of orthologs and paralogs.

10. Production of Polypeptide Using ORF Derived from Coryneform Bacteria

The polypeptide of the present invention can be produced using a polynucleotide comprising the ORF obtained in the above item 2. Specifically, the polypeptide of the present invention can be produced by expressing the polynucleotide of the present invention or a fragment thereof in a host cell, using the method described in *Molecular Cloning*, 2nd ed., *Current Protocols in Molecular Biology*, and the like, for example, according to the following method.

A DNA fragment having a suitable length containing a part encoding the polypeptide is prepared from the full length ORF sequence, if necessary.

Also, DNA in which nucleotides in a nucleotide sequence at a part encoding the polypeptide of the present invention are replaced to give a codon suitable for expression of the host cell, if necessary. The DNA is useful for efficiently producing the polypeptide of the present invention.

A recombinant vector is prepared by inserting the DNA fragment into the downstream of a promoter in a suitable expression vector.

The recombinant vector is introduced to a host cell suitable for the expression vector.

Any of bacteria, yeasts, animal cells, insect cells, plant cells, and the like can be used as the host cell so long as it can be expressed in the gene of interest.

Examples of the expression vector include those which can replicate autonomously in the above-described host cell or can be integrated into chromosome and have a promoter at such a position that the DNA encoding the polypeptide of the present invention can be transcribed.

When a procaryote cell, such as a bacterium or the like, is used as the host cell, it is preferred that the recombinant vector containing the DNA encoding the polypeptide of the present invention can replicate autonomously in the bacterium and is a recombinant vector constituted by, at least a promoter, a ribosome binding sequence, the DNA of the present invention and a transcription termination sequence. A promoter controlling gene can also be contained therewith in operable combination.

Examples of the expression vectors include a vector plasmid which is replicable in *Corynebacterium glutamicum*, such as pCG1 (Japanese Published Unexamined Patent Application No. 134500/82), pCG2 (Japanese Published Unexamined Patent Application No. 35197/83), pCG4 (Japanese Published Unexamined Patent Application No. 183799/82), pCG11 (Japanese Published Unexamined Patent Application No. 134500/82), pCG116, pCE54 and pCB101 (Japanese Published Unexamined Patent Application No. 105999/83), pCE51, pCE52 and pCE53 (*Mol. Gen. Genet.*, 196: 175-178 (1984)), and the like; a vector plasmid which is replicable in *Escherichia coli*, such as pET3 and pET11 (manufactured by Stratagene), pBAD, pThioHis and pTrcHis (manufactured by Invitrogen), pKK223-3 and pGEX2T (manufactured by Amersham Pharmacia Biotech), and the like; and pBTrp2, pBTac1 and pBTac2 (manufactured by Boehringer Mannheim Co.), pSE280 (manufactured by Invitrogen), pGEMEX-1 (manufactured by Promega), pQE-8 (manufactured by QIAGEN), pKYP10 (Japanese Published Unexamined Patent Application No.

110600/83), pKYP200 (*Agric. Biol. Chem.,* 48: 669 (1984)), pLSA1 (*Agric. Biol. Chem.,* 53: 277 (1989)), pGEL1 (*Proc. Natl. Acad. Sci. USA,* 82: 4306 (1985)), pBluescript II SK(−) (manufactured by Stratagene), pTrs30 (prepared from *Escherichia coli* JM109/pTrS30 (FERM BP-5407)), pTrs32 (prepared from *Escherichia coli* JM109/pTrS32 (FERM BP-5408)), pGHA2 (prepared from *Escherichia coli* IGHA2 (FERM B-400), Japanese Published Unexamined Patent Application No. 221091/85), pGKA2 (prepared from *Escherichia coli* IGKA2 (FERM BP-6798), Japanese Published Unexamined Patent Application No. 221091/85), pTerm2 (U.S. Pat. Nos. 4,686,191, 4,939,094 and 5,160,735), pSupex, pUB110, pTP5, pC194 and pEG400 (*J. Bacteriol.,* 172: 2392 (1990)), pGEX (manufactured by Pharmacia), pET system (manufactured by Novagen), and the like.

Any promoter can be used so long as it can function in the host cell. Examples include promoters derived from *Escherichia coli*, phage and the like, such as trp promoter ($P_{trp}$), lac promoter, $P_L$ promoter, $P_R$ promoter, T7 promoter and the like. Also, artificially designed and modified promoters, such as a promoter in which two Ptrp are linked in series ($P_{trp}×2$), tac promoter, lacT7 promoter letI promoter and the like, can be used.

It is preferred to use a plasmid in which the space between Shine-Dalgarno sequence which is the ribosome binding sequence and the initiation codon is adjusted to an appropriate distance (for example, 6 to 18 nucleotides).

The transcription termination sequence is not always necessary for the expression of the DNA of the present invention. However, it is preferred to arrange the transcription terminating sequence at just downstream of the structural gene.

One of ordinary skill in the art will appreciate that the codons of the above-described elements may be optimized, in a known manner, depending on the host cells and environmental conditions utilized.

Examples of the host cell include microorganisms belonging to the genus *Escherichia*, the genus *Serratia*, the genus *Bacillus*, the genus *Brevibacterium*, the genus *Corynebacterium*, the genus *Microbacterium*, the genus *Pseudomonas*, and the like. Specific examples include *Escherichia coli* XL1-Blue, *Escherichia coli* XL2-Blue, *Escherichia coli* DH1, *Escherichia coli* MC1000, *Escherichia coli* KY3276, *Escherichia coli* W1485; *Escherichia coli* JM109, *Escherichia coli* HB101, *Escherichia coli* No. 49, *Escherichia coli* W3110, *Escherichia coli* NY49, *Escherichia coli* G1698, *Escherichia coli* TB1, *Serratia ficaria*, *Serratia fonticola*, *Serratia liquefaciens*, *Serratia marcescens*, *Bacillus subtilis*, *Bacillus amyloliquefaciens*, *Corynebacterium ammoniagenes*, *Brevibacterium immariophilum* ATCC 14068, *Brevibacterium saccharolyticum* ATCC 14066, *Corynebacterium glutamicum* ATCC 13032, *Corynebacterium glutamicum* ATCC 13869, *Corynebacterium glutamicum* ATCC 14067 (prior genus and species: *Brevibacterium flavum*), *Corynebacterium glutamicum* ATCC 13869 (prior genus and species: *Brevibacterium lactofermentum*, or *Corynebacterium lactofermentum*), *Corynebacterium acetoacidophilum* ATCC 13870, *Corynebacterium thermoaminogenes* FERM 9244, *Microbacterium ammoniaphilum* ATCC 15354, *Pseudomonas putida*, *Pseudomonas* sp. D-0110, and the like.

When *Corynebacterium glutamicum* or an analogous microorganism is used as a host, an EMF necessary for expressing the polypeptide is not always contained in the vector so long as the polynucleotide of the present invention contains an EMF. When the EMF is not contained in the polynucleotide, it is necessary to prepare the EMF separately and ligate it so as to be in operable combination. Also, when a higher expression amount or specific expression regulation is necessary, it is necessary to ligate the EMF corresponding thereto so as to put the EMF in operable combination with the polynucleotide. Examples of using an externally ligated EMF are disclosed in *Microbiology,* 142: 1297-1309 (1996).

With regard to the method for the introduction of the recombinant vector, any method for introducing DNA into the above-described host cells, such as a method in which a calcium ion is used (*Proc. Natl. Acad. Sci. USA,* 69: 2110 (1972)), a protoplast method (Japanese Published Unexamined Patent Application No. 2483942/88), the methods described in *Gene,* 17: 107 (1982) and *Molecular & General Genetics,* 168: 111 (1979) and the like, can be used.

When yeast is used as the host cell, examples of the expression vector include pYES2 (manufactured by Invitrogen), YEp13 (ATCC 37115), YEp24 (ATCC 37051), YCp50 (ATCC 37419), pHS19, pHS15, and the like.

Any promoter can be used so long as it can be expressed in yeast. Examples include a promoter of a gene in the glycolytic pathway, such as hexose kinase and the like, PHO5 promoter, PGK promoter, GAP promoter, ADH promoter, gal 1 promoter, gal 10 promoter, a heat shock protein promoter, MF α1 promoter, CUP 1 promoter, and the like.

Examples of the host cell include microorganisms belonging to the genus *Saccharomyces*, the genus *Schizosaccharomyces*, the genus *Kluyveromyces*, the genus *Trichosporon*, the genus *Schwanniomyces*, the genus *Pichia*, the genus *Candida* and the like. Specific examples include *Saccharomyces cerevisiae, Schizosaccharomyces pombe, Kluyveromyces lactis, Trichosporon pullulans, Schwanniomyces alluvius, Candida utilis* and the like.

With regard to the method for the introduction of the recombinant vector, any method for introducing DNA into yeast, such as an electroporation method (*Methods. Enzymol.,* 194: 182 (1990)), a spheroplast method (*Proc. Natl. Acad. Sci. USA,* 75: 1929 (1978)), a lithium acetate method (*J. Bacteriol.,* 153: 163 (1983)), a method described in *Proc. Natl. Acad. Sci. USA,* 75: 1929 (1978) and the like, can be used.

When animal cells are used as the host cells, examples of the expression vector include pcDNA3.1, pSinRep5 and pCEP4 (manufactured by Invitorogen), pRev-Tre (manufactured by Clontech), pAxCAwt (manufactured by Takara Shuzo), pcDNAI and pcDM8 (manufactured by Funakoshi), pAGE107 (Japanese Published Unexamined Patent Application No. 22979/91; *Cytotechnology,* 3:133 (1990)), pAS3-3 (Japanese Published Unexamined Patent Application No. 227075/90), pcDM8 (*Nature,* 329: 840 (1987)), pcDNAI/Amp (manufactured by Invitrogen), pREP4 (manufactured by Invitrogen), pAGE103 (*J. Biochem.,* 101: 1307 (1987)), pAGE210, and the like.

Any promoter can be used so long as it can function in animal cells. Examples include a promoter of IE (immediate early) gene of cytomegalovirus (CMV), an early promoter of SV40, a promoter of retrovirus, a metallothionein promoter, a heat shock promoter, SRα promoter, and the like. Also, the enhancer of the IE gene of human CMV can be used together with the promoter.

Examples of the host cell include human Namalwa cell, monkey COS cell, Chinese hamster CHO cell, HST5637 (Japanese Published Unexamined Patent Application No. 299/88), and the like.

The method for introduction of the recombinant vector into animal cells is not particularly limited, so long as it is the general method for introducing DNA into animal cells, such as an electroporation method (*Cytotechnology*, 3: 133 (1990)), a calcium phosphate method (Japanese Published Unexamined Patent Application No. 227075/90), a lipofection method (*Proc. Natl. Acad. Sci. USA*, 84, 7413 (1987)), the method described in *Virology*, 52: 456 (1973), and the like.

When insect cells are used as the host cells, the polypeptide can be expressed, for example, by the method described in *Bacurovirus Expression Vectors, A Laboratory Manual*, W.H. Freeman and Company, New York (1992), *Bio/Technology*, 6: 47 (1988), or the like.

Specifically, a recombinant gene transfer vector and bacurovirus are simultaneously inserted into insect cells to obtain a recombinant virus in an insect cell culture supernatant, and then the insect cells are infected with the resulting recombinant virus to express the polypeptide.

Examples of the gene introducing vector used in the method include pBlueBac4.5, pVL1392, pVL1393 and pBlueBacIII (manufactured by Invitrogen), and the like.

Examples of the bacurovirus include *Autographa californica* nuclear polyhedrosis virus with which insects of the family Barathra are infected, and the like.

Examples of the insect cells include *Spodoptera frugiperda* oocytes Sf9 and Sf21 (*Bacurovirus Expression Vectors, A Laboratory Manual*, W.H. Freeman and Company, New York (1992)), *Trichoplusia ni* oocyte High 5 (manufactured by Invitrogen) and the like.

The method for simultaneously incorporating the above-described recombinant gene transfer vector and the above-described bacurovirus for the preparation of the recombinant virus include calcium phosphate method (Japanese Published Unexamined Patent Application No. 227075/90), lipofection method (*Proc. Natl. Acad. Sci. USA*, 84: 7413 (1987)) and the like.

When plant cells are used as the host cells, examples of expression vector include a Ti plasmid, a tobacco mosaic virus vector, and the like.

Any promoter can be used so long as it can be expressed in plant cells. Examples include 35S promoter of cauliflower mosaic virus (CaMV), rice actin 1 promoter, and the like.

Examples of the host cells include plant cells and the like, such as tobacco, potato, tomato, carrot, soybean, rape, alfalfa, rice, wheat, barley, and the like.

The method for introducing the recombinant vector is not particularly limited, so long as it is the general method for introducing DNA into plant cells, such as the Agrobacterium method (Japanese Published Unexamined Patent Application No. 140885/84, Japanese Published Unexamined Patent Application No. 70080/85, WO 94/00977), the electroporation method (Japanese Published Unexamined Patent Application, No. 251887/85), the particle gun method (Japanese Patents 2606856 and 2517813), and the like.

The transformant of the present invention includes a transformant containing the polypeptide of the present invention per se rather than as a recombinant vector, that is, a transformant containing the polypeptide of the present invention which is integrated into a chromosome of the host, in addition to the transformant containing the above recombinant vector.

When expressed in yeasts, animal cells, insect cells or plant cells, a glycopolypeptide or glycosylated polypeptide can be obtained.

The polypeptide can be produced by culturing the thus obtained transformant of the present invention in a culture medium to produce and accumulate the polypeptide of the present invention or any polypeptide expressed under the control of an EMF of the present invention, and recovering the polypeptide from the culture.

Culturing of the transformant of the present invention in a culture medium is carried out according to the conventional method as used in culturing of the host.

When the transformant of the present invention is obtained using a prokaryote, such as *Escherichia coli* or the like, or a eukaryote, such as yeast or the like, as the host, the transformant is cultured.

Any of a natural medium and a synthetic medium can be used, so long as it contains a carbon source, a nitrogen source, an inorganic salt and the like which can be assimilated by the transformant and can perform culturing of the transformant efficiently.

Examples of the carbon source include those which can be assimilated by the transformant, such as carbohydrates (for example, glucose, fructose, sucrose, molasses containing them, starch, starch hydrolysate, and the like), organic acids (for example, acetic acid, propionic acid, and the like), and alcohols (for example, ethanol, propanol, and the like).

Examples of the nitrogen source include ammonia, various ammonium salts of inorganic acids or organic acids (for example, ammonium chloride, ammonium sulfate, ammonium acetate, ammonium phosphate, and the like), other nitrogen-containing compounds, peptone, meat extract, yeast extract, corn steep liquor, casein hydrolysate, soybean meal and soybean meal hydrolysate, various fermented cells and hydrolysates thereof, and the like.

Examples of inorganic salt include potassium dihydrogen phosphate, dipotassium hydrogen phosphate, magnesium phosphate, magnesium sulfate, sodium chloride, ferrous sulfate, manganese sulfate, copper sulfate, calcium carbonate, and the like.

The culturing is carried out under aerobic conditions by shaking culture, submerged-aeration stirring culture or the like. The culturing temperature is preferably from 15 to 40° C., and the culturing time is generally from 16 hours to 7 days. The pH of the medium is preferably maintained at 3.0 to 9.0 during the culturing. The pH can be adjusted using an inorganic or organic acid, an alkali solution, urea, calcium carbonate, ammonia, or the like.

Also, antibiotics, such as ampicillin, tetracycline, and the like, can be added to the medium during the culturing, if necessary.

When a microorganism transformed with a recombinant vector containing an inducible promoter is cultured, an inducer can be added to the medium, if necessary.

For example, isopropyl-β-D-thiogalactopyranoside (IPTG) or the like can be added to the medium when a microorganism transformed with a recombinant vector containing lac promoter is cultured, or indoleacrylic acid (IAA) or the like can by added thereto when a microorganism transformed with an expression vector containing trp promoter is cultured.

Examples of the medium used in culturing a transformant obtained using animal cells as the host cells include RPMI 1640 medium (*The Journal of the American Medical Association*, 199: 519 (1967)), Eagle's MEM medium (*Science*, 122: 501 (1952)), Dulbecco's modified MEM medium (*Virology*, 8, 396 (1959)), 199 Medium (*Proceeding of the Society for the Biological Medicine*, 73:1 (1950)), the above-described media to which fetal calf serum has been added, and the like.

The culturing is carried out generally at a pH of 6 to 8 and a temperature of 30 to 40° C. in the presence of 5% $CO_2$ for 1 to 7 days.

Also, if necessary, antibiotics, such as kanamycin, penicillin, and the like, can be added to the medium during the culturing.

Examples of the medium used in culturing a transformant obtained using insect cells as the host cells include TNM-FH medium (manufactured by Pharmingen), Sf-900 II SFM (manufactured by Life Technologies), ExCell 400 and ExCell 405 (manufactured by JRH Biosciences), Grace's Insect Medium (*Nature*, 195: 788 (1962)), and the like.

The culturing is carried out generally at a pH of 6 to 7 and a temperature of 25 to 30° C. for 1 to 5 days.

Additionally, antibiotics, such as gentamicin and the like, can be added to the medium during the culturing, if necessary.

A transformant obtained by using a plant cell as the host cell can be used as the cell or after differentiating to a plant cell or organ. Examples of the medium used in the culturing of the transformant include Murashige and Skoog (MS) medium, White medium, media to which a plant hormone, such as auxin, cytokinine, or the like has been added, and the like.

The culturing is carried out generally at a pH of 5 to 9 and a temperature of 20 to 40° C. for 3 to 60 days.

Also, antibiotics, such as kanamycin, hygromycin and the like, can be added to the medium during the culturing, if necessary.

As described above, the polypeptide can be produced by culturing a transformant derived from a microorganism, animal cell or plant cell containing a recombinant vector to which a DNA encoding the polypeptide of the present invention has been inserted according to the general culturing method to produce and accumulate the polypeptide, and recovering the polypeptide from the culture.

The process of gene expression may include secretion of the encoded protein production or fusion protein expression and the like in accordance with the methods described in *Molecular Cloning*, 2nd ed., in addition to direct expression.

The method for producing the polypeptide of the present invention includes a method of intracellular expression in a host cell, a method of extracellular secretion from a host cell, or a method of production on a host cell membrane outer envelope. The method can be selected by changing the host cell employed or the structure of the polypeptide produced.

When the polypeptide of the present invention is produced in a host cell or on a host cell membrane outer envelope, the polypeptide can be positively secreted extracellularly according to, for example, the method of Paulson et al. (*J. Biol. Chem.*, 264: 17619 (1989)), the method of Lowe et al. (*Proc. Natl. Acad. Sci. USA*, 86: 8227 (1989); *Genes Develop.*, 4: 1288 (1990)), and/or the methods described in Japanese Published Unexamined Patent Application No. 336963/93, WO 94/23021, and the like.

Specifically, the polypeptide of the present invention can be positively secreted extracellularly by expressing it in the form that a signal peptide has been added to the foreground of a polypeptide containing an active site of the polypeptide of the present invention according to the recombinant DNA technique.

Furthermore, the amount produced can be increased using a gene amplification system, such as by use of a dihydrofolate reductase gene or the like according to the method described in Japanese Published Unexamined Patent Application No. 227075/90.

Moreover, the polypeptide of the present invention can be produced by a transgenic animal individual (transgenic nonhuman animal) or plant individual (transgenic plant).

When the transformant is the animal individual or plant individual, the polypeptide of the present invention can be produced by breeding or cultivating it so as to produce and accumulate the polypeptide, and recovering the polypeptide from the animal individual or plant individual.

Examples of the method for producing the polypeptide of the present invention using the animal individual include a method for producing the polypeptide of the present invention in an animal developed by inserting a gene according to methods known to those of ordinary skill in the art (*American Journal of Clinical Nutrition*, 63: 639S (1996), *American Journal of Clinical Nutrition*, 63: 627S (1996), *Bio/Technology*, 9: 830 (1991)).

In the animal individual, the polypeptide can be produced by breeding a transgenic nonhuman animal to which the DNA encoding the polypeptide of the present invention has been inserted to produce and accumulate the polypeptide in the animal, and recovering the polypeptide from the animal. Examples of the production and accumulation place in the animal include milk (Japanese Published Unexamined Patent Application No. 309192/88), egg and the like of the animal. Any promoter can be used, so long as it can be expressed in the animal. Suitable examples include an α-casein promoter, a β-casein promoter, a β-lactoglobulin promoter, a whey acidic protein promoter, and the like, which are specific for mammary glandular cells.

Examples of the method for producing the polypeptide of the present invention using the plant individual include a method for producing the polypeptide of the present invention by cultivating a transgenic plant to which the DNA encoding the protein of the present invention by a known method (*Tissue Culture*, 20 (1994), *Tissue Culture*, 21 (1994), *Trends in Biotechnology*, 15: 45 (1997)) to produce and accumulate the polypeptide in the plant, and recovering the polypeptide from the plant.

The polypeptide according to the present invention can also be obtained by translation in vitro.

The polypeptide of the present invention can be produced by a translation system in vitro. There are, for example, two in vitro translation methods which may be used, namely, a method using RNA as a template and another method using DNA as a template. The template RNA includes the whole RNA, mRNA, an in vitro transcription product, and the like. The template DNA includes a plasmid containing a transcriptional promoter and a target gene integrated therein and downstream of the initiation site, a PCR/RT-PCR product and the like. To select the most suitable system for the in vitro translation, the origin of the gene encoding the protein to be synthesized (prokaryotic cell/eucaryotic cell), the type of the template (DNA/RNA), the purpose of using the synthesized protein and the like should be considered. In vitro translation kits having various characteristics are commercially available from many companies (Boehringer Mannheim, Promega, Stratagene, or the like), and every kit can be used in producing the polypeptide according to the present invention.

Transcription/translation of a DNA nucleotide sequence cloned into a plasmid containing a T7 promoter can be carried out using an in vitro transcription/translation system *E. coli* T7 S30 Extract System for Circular DNA (manufactured by Promega, catalogue No. L1130). Also, transcription/translation using, as a template, a linear prokaryotic DNA of a supercoil non-sensitive promoter, such as lacUV5, tac, λPL(con), λPL, or the like, can be carried out using an in vitro transcription/translation system *E. coli* S30 Extract System for Linear Templates (manufactured by Promega, catalogue No. L1030). Examples of the linear prokaryotic DNA used as a template include a DNA fragment, a PCR-amplified DNA product, a duplicated oligonucleotide ligation, an in vitro transcriptional RNA, a prokaryotic RNA, and the like.

In addition to the production of the polypeptide according to the present invention, synthesis of a radioactive labeled protein, confirmation of the expression capability of a cloned gene, analysis of the function of transcriptional reaction or translation reaction, and the like can be carried out using this system.

The polypeptide produced by the transformant of the present invention can be isolated and purified using the general method for isolating and purifying an enzyme. For example, when the polypeptide of the present invention is expressed as a soluble product in the host cells, the cells are collected by centrifugation after cultivation, suspended in an aqueous buffer, and disrupted using an ultrasonicator, a French press, a Manton Gaulin homogenizer, a Dynomill, or the like to obtain a cell-free extract. From the supernatant obtained by centrifuging the cell-free extract, a purified product can be obtained by the general method used for isolating and purifying an enzyme, for example, solvent extraction, salting out using ammonium sulfate or the like, desalting, precipitation using an organic solvent, anion exchange chromatography using a resin, such as diethylaminoethyl (DEAE)-Sepharose, DIAION HPA-75 (manufactured by Mitsubishi Chemical) or the like, cation exchange chromatography using a resin, such as S-Sepharose FF (manufactured by Pharmacia) or the like, hydrophobic chromatography using a resin, such as butyl sepharose, phenyl sepharose or the like, gel filtration using a molecular sieve, affinity chromatography, chromatofocusing, or electrophoresis, such as isoelectronic focusing or the like, alone or in combination thereof.

When the polypeptide is expressed as an insoluble product in the host cells, the cells are collected in the same manner, disrupted and centrifuged to recover the insoluble product of the polypeptide as the precipitate fraction. Next, the insoluble product of the polypeptide is solubilized with a protein denaturing agent. The solubilized solution is diluted or dialyzed to lower the concentration of the protein denaturing agent in the solution. Thus, the normal configuration of the polypeptide is reconstituted. After the procedure, a purified product of the polypeptide can be obtained by a purification/isolation method similar to the above.

When the polypeptide of the present invention or its derivative (for example, a polypeptide formed by adding a sugar chain thereto) is secreted out of cells, the polypeptide or its derivative can be collected in the culture supernatant. Namely, the culture supernatant is obtained by treating the culture medium in a treatment similar to the above (for example, centrifugation). Then, a purified product can be obtained from the culture medium using a purification/isolation method similar to the above.

The polypeptide obtained by the above method is within the scope of the polypeptide of the present invention, and examples include a polypeptide encoded by a polynucleotide comprising the nucleotide sequence selected from SEQ ID NOS:2 to 3431, and a polypeptide comprising an amino acid sequence represented by any one of SEQ ID NOS:3502 to 6931.

Furthermore, a polypeptide comprising an amino acid sequence in which at least one amino acids is deleted, replaced, inserted or added in the amino acid sequence of the polypeptide and having substantially the same activity as that of the polypeptide is included in the scope of the present invention. The term "substantially the same activity as that of the polypeptide" means the same activity represented by the inherent function, enzyme activity or the like possessed by the polypeptide which has not been deleted, replaced, inserted or added. The polypeptide can be obtained using a method for introducing part-specific mutation(s) described in, for example, Molecular Cloning, 2nd ed., Current Protocols in Molecular Biology, Nuc. Acids. Res., 10: 6487 (1982), Proc. Natl. Acad. Sci. USA, 79: 6409 (1982), Gene, 34: 315 (1985), Nuc. Acids. Res., 13: 4431 (1985), Proc. Natl. Acad. Sci. USA, 82: 488 (1985) and the like. For example, the polypeptide can be obtained by introducing mutation(s) to DNA encoding a polypeptide having the amino acid sequence represented by any one of SEQ ID NOS:3502 to 6931. The number of the amino acids which are deleted, replaced, inserted or added is not particularly limited; however, it is usually 1 to the order of tens, preferably 1 to 20, more preferably 1 to 10, and most preferably 1 to 5, amino acids.

The at least one amino acid deletion, replacement, insertion or addition in the amino acid sequence of the polypeptide of the present invention is used herein to refer to that at least one amino acid is deleted, replaced, inserted or added to at one or plural positions in the amino acid sequence. The deletion, replacement, insertion or addition may be caused in the same amino acid sequence simultaneously. Also, the amino acid residue replaced, inserted or added can be natural or non-natural. Examples of the natural amino acid residue include L-alanine, L-asparagine, L-aspartic acid, L-glutamine, L-glutamic acid, glycine, L-histidine, L-isoleucine, L-leucine, L-lysine, L-methionine, L-phenylalanine, L-proline, L-serine, L-threonine, L-tryptophan, L-tyrosine, L-valine, L-cysteine, and the like.

Herein, examples of amino acid residues which are replaced with each other are shown below. The amino acid residues in the same group can be replaced with each other.

Group A:
leucine, isoleucine, norleucine, valine, norvaline, alanine, 2-aminobutanoic acid, methionine, O-methylserine, t-butylglycine, t-butylalanine, cyclohexylalanine;

Group B:
asparatic acid, glutamic acid, isoasparatic acid, isoglutamic acid, 2-aminoadipic acid, 2-aminosuberic acid;

Group C:
asparagine, glutamine;

Group D:
lysine, arginine, ornithine, 2,4-diaminobutanoic acid, 2,3-diaminopropionic acid;

Group E:
proline, 3-hydroxyproline, 4-hydroxyproline;

Group F:
serine, threonine, homoserine;

Group G:
phenylalanine, tyrosine.

Also, in order that the resulting mutant polypeptide has substantially the same activity as that of the polypeptide which has not been mutated, it is preferred that the mutant polypeptide has a homology of 60% or more, preferably 80% or more, and particularly preferably 95% or more, with the polypeptide which has not been mutated, when calculated, for example, using default (initial setting) parameters by a homology searching software, such as BLAST, FASTA, or the like.

Also, the polypeptide of the present invention can be produced by a chemical synthesis method, such as Fmoc (fluorenylmethyloxycarbonyl) method, tBoc (t-butyloxycarbonyl) method, or the like. It can also be synthesized using a peptide synthesizer manufactured by Advanced ChemTech, Perkin-Elmer, Pharmacia, Protein Technology Instrument, Synthecell-Vega, PerSeptive, Shimadzu Corporation, or the like.

The transformant of the present invention can be used for objects other than the production of the polypeptide of the present invention.

Specifically, at least one component selected from an amino acid, a nucleic acid, a vitamin, a saccharide, an organic acid, and analogues thereof can be produced by culturing the transformant containing the polynucleotide or recombinant vector of the present invention in a medium to produce and accumulate at least one component selected from amino acids, nucleic acids, vitamins, saccharides, organic acids, and analogues thereof, and recovering the same from the medium.

The biosynthesis pathways, decomposition pathways and regulatory mechanisms of physiologically active substances such as amino acids, nucleic acids, vitamins, saccharides, organic acids and analogues thereof differ from organism to organism. The productivity of such a physiologically active substance can be improved using these differences, specifically by introducing a heterogeneous gene relating to the biosynthesis thereof. For example, the content of lysine, which is one of the essential amino acids, in a plant seed was improved by introducing a synthase gene derived from a bacterium (WO 93/19190). Also, arginine is excessively produced in a culture by introducing an arginine synthase gene derived from *Escherichia coli* (Japanese Examined Patent Publication 23750/93).

To produce such a physiologically active substance, the transformant according to the present invention can be cultured by the same method as employed in culturing the transformant for producing the polypeptide of the present invention as described above. Also, the physiologically active substance can be recovered from the culture medium in combination with, for example, the ion exchange resin method, the precipitation method and other known methods.

Examples of methods known to one of ordinary skill in the art include electroporation, calcium transfection, the protoplast method, the method using a phage, and the like, when the host is a bacterium; and microinjection, calcium phosphate transfection, the positively charged lipid-mediated method and the method using a virus, and the like, when the host is a eukaryote (*Molecular Cloning*, 2nd. ed.; Spector et al., *Cells/a laboratory manual*, Cold Spring Harbour Laboratory Press, 1998)). Examples of the host include prokaryotes, lower eukaryotes (for example, yeasts), higher eukaryotes (for example, mammals), and cells isolated therefrom. As the state of a recombinant polynucleotide fragment present in the host cells, it can be integrated into the chromosome of the host. Alternatively, it can be integrated into a factor (for example, a plasmid) having an independent replication unit outside the chromosome. These transformants are usable in producing the polypeptides of the present invention encoded by the ORF of the genome of *Corynebacterium glutamicum*, the polynucleotides of the present invention and fragments thereof. Alternatively, they can be used in producing arbitrary polypeptides under the regulation by an EMF of the present invention.

11. Preparation of Antibody Recognizing the Polypeptide of the Present Invention An antibody which recognizes the polypeptide of the present invention, such as a polyclonal antibody, a monoclonal antibody, or the like, can be produced using, as an antigen, a purified product of the polypeptide of the present invention or a partial fragment polypeptide of the polypeptide or a peptide having a partial amino acid sequence of the polypeptide of the present invention.

(1) Production of Polyclonal Antibody

A polyclonal antibody can be produced using, as an antigen, a purified product of the polypeptide of the present invention, a partial fragment polypeptide of the polypeptide, or a peptide having a partial amino acid sequence of the polypeptide of the present invention, and immunizing an animal with the same.

Examples of the animal to be immunized include rabbits, goats, rats, mice, hamsters, chickens and the like.

A dosage of the antigen is preferably 50 to 100 µg per animal.

When the peptide is used as the antigen, it is preferably a peptide covalently bonded to a carrier protein, such as keyhole limpet haemocyanin, bovine thyroglobulin, or the like. The peptide used as the antigen can be synthesized by a peptide synthesizer.

The administration of the antigen is, for example, carried out 3 to 10 times at the intervals of 1 or 2 weeks after the first administration. On the 3rd to 7th day after each administration, a blood sample is collected from the venous plexus of the eyeground, and it is confirmed that the serum reacts with the antigen by the enzyme immunoassay (*Enzyme-linked Immunosorbent Assay* (*ELISA*), Igaku Shoin (1976); *Antibodies—A Laboratory Manual*, Cold Spring Harbor Laboratory (1988)) or the like.

Serum is obtained from the immunized non-human mammal with a sufficient antibody titer against the antigen used for the immunization, and the serum is isolated and purified to obtain a polyclonal antibody.

Examples of the method for the isolation and purification include centrifugation, salting out by 40-50% saturated ammonium sulfate, caprylic acid precipitation (*Antibodies, A Laboratory manual*, Cold Spring Harbor Laboratory (1988)), or chromatography using a DEAE-Sepharose column, an anion exchange column, a protein A- or G-column, a gel filtration column, and the like, alone or in combination thereof, by methods known to those of ordinary skill in the art.

(2) Production of Monoclonal Antibody (a) Preparation of Antibody-Producing Cell A rat having a serum showing an enough antibody titer against a partial fragment polypeptide of the polypeptide of the present invention used for immunization is used as a supply source of an antibody-producing cell.

On the 3rd to 7th day after the antigen substance is finally administered the rat showing the antibody titer, the spleen is excised.

The spleen is cut to pieces in MEM medium (manufactured by Nissui Pharmaceutical), loosened using a pair of forceps, followed by centrifugation at 1,200 rpm for 5 minutes, and the resulting supernatant is discarded.

The spleen in the precipitated fraction is treated with a Tris-ammonium chloride buffer (pH 7.65) for 1 to 2 minutes to eliminate erythrocytes and washed three times with MEM medium, and the resulting spleen cells are used as antibody-producing cells.

(b) Preparation of Myeloma Cells

As myeloma cells, an established cell line obtained from mouse or rat is used. Examples of useful cell lines include those derived from a mouse, such as P3-X63Ag8-U1 (hereinafter referred to as "UP3-U1") (*Curr. Topics in Microbiol. Immunol.*, 81: 1 (1978); *Europ. J. Immunol.*, 6: 511 (1976)); SP2/O-Ag14 (SP-2) (*Nature*, 276: 269 (1978)): P3-X63-Ag8653 (653) (*J. Immunol*, 123: 1548 (1979)); P3-X63-Ag8 (X63) cell line (*Nature*, 256: 495 (1975)), and the like, which are 8-azaguanine-resistant mouse (BALB/c) myeloma cell lines. These cell lines are subcultured in 8-azaguanine medium (medium in which, to a medium obtained by adding. 1.5 mmol/l glutamine, $5 \times 10^{-5}$ mol/l 2-mercaptoethanol, 10 µg/ml gentamicin and 10% fetal calf serum (FCS) (manufactured by CSL) to RPMI-1640 medium (hereinafter referred to as the "normal medium"), 8-azaguanine is further added at 15 µg/ml) and cultured in the normal medium 3 or 4 days before cell fusion, and $2 \times 10^7$ or more of the cells are used for the fusion.

(c) Production of Hybridoma

The antibody-producing cells obtained in (a) and the myeloma cells obtained in (b) are washed with MEM medium or PBS (disodium hydrogen phosphate: 1.83 g, sodium dihydrogen phosphate: 0.21 g, sodium chloride: 7.65 g, distilled water: 1 liter, pH: 7.2) and mixed to give a ratio of antibody-producing cells:myeloma cells=5:1 to 10:1, followed by centrifugation at 1,200 rpm for 5 minutes, and the supernatant is discarded.

The cells in the resulting precipitated fraction were thoroughly loosened, 0.2 to 1 ml of a mixed solution of 2 g of polyethylene glycol-1000 (PEG-1000), 2 ml of MEM medium and 0.7 ml of dimethylsulfoxide (DMSO) per $10^8$ antibody-producing cells is added to the cells under stirring at 37° C., and then 1 to 2 ml of MEM medium is further added thereto several times at 1 to 2 minute intervals.

After the addition, MEM medium is added to give a total amount of 50 ml. The resulting prepared solution is centrifuged at 900 rpm for 5 minutes, and then the supernatant is discarded. The cells in the resulting precipitated fraction were gently loosened and then gently suspended in 100 ml of HAT medium (the normal medium to which $10^{-4}$ mol/l hypoxanthine, $1.5 \times 10^{-5}$ mol/l thymidine and $4 \times 10^{-7}$ mol/l aminopterin have been added) by repeated drawing up into and discharging from a measuring pipette.

The suspension is poured into a 96 well culture plate at 100 µl/well and cultured at 37° C. for 7 to 14 days in a 5% $CO_2$ incubator.

After culturing, a part of the culture supernatant is recovered, and a hybridoma which specifically reacts with a partial fragment polypeptide of the polypeptide of the present invention is selected according to the enzyme immunoassay described in *Antibodies, A Laboratory manual*, Cold Spring Harbor Laboratory, Chapter 14 (1998) and the like.

A specific example of the enzyme immunoassay is described below.

The partial fragment polypeptide of the polypeptide of the present invention used as the antigen in the immunization is spread on a suitable plate, is allowed to react with a hybridoma culturing supernatant or a purified antibody obtained in (d) described below as a first antibody, and is further allowed to react with an anti-rat or anti-mouse immunoglobulin antibody labeled with an enzyme, a chemical luminous substance, a radioactive substance or the like as a second antibody for reaction suitable for the labeled substance. A hybridoma which specifically reacts with the polypeptide of the present invention is selected as a hybridoma capable of producing a monoclonal antibody of the present invention.

Cloning is repeated using the hybridoma twice by limiting dilution analysis (HT medium (a medium in which aminopterin has been removed from HAT medium) is firstly used, and the normal medium is secondly used), and a hybridoma which is stable and contains a sufficient amount of antibody titer is selected as a hybridoma capable of producing a monoclonal antibody of the present invention.

(d) Preparation of Monoclonal Antibody

The monoclonal antibody-producing hybridoma cells obtained in (c) are injected intraperitoneally into 8- to 10-week-old mice or nude mice treated with pristane (intraperitoneal administration of 0.5 ml of 2,6,10,14-tetramethylpentadecane (pristane) followed by 2 weeks of feeding) at $5 \times 10^6$ to $20 \times 10^6$ cells/animal. The hybridoma causes ascites tumor in 10 to 21 days.

The ascitic fluid is collected from the mice or nude mice, and centrifuged to remove solid contents at 3000 rpm for 5 minutes.

A monoclonal antibody can be purified and isolated from the resulting supernatant according to the method similar to that used in the polyclonal antibody.

The subclass of the antibody can be determined using a mouse monoclonal antibody typing kit or a rat monoclonal antibody typing kit. The polypeptide amount can be determined by the Lowry method or by calculation based on the absorbance at 280 nm.

The antibody obtained in the above is within the scope of the antibody of the present invention.

The antibody can be used for the general assay using an antibody, such as a radioactive material labeled immunoassay (RIA), competitive binding assay, an immunotissue chemical staining method (ABC method, CSA method, etc.), immunoprecipitation, Western blotting, ELISA assay, and the like (*An introduction to Radioimmunoassay and Related Techniques*, Elsevier Science (1986); *Techniques in Immunocytochemistry*, Academic Press, Vol. 1 (1982), Vol. 2 (1983) & Vol. 3 (1985); *Practice and Theory of Enzyme Immunoassays*, Elsevier Science (1985); *Enzyme-linked Immunosorbent Assay (ELISA)*, Igaku Shoin (1976); *Antibodies—A Laboratory Manual*, Cold Spring Harbor laboratory (1988); *Monoclonal Antibody Experiment Manual*, Kodansha Scientific (1987); *Second Series Biochemical*

*Experiment Course,* Vol. 5, Immunobiochemistry Research Method, Tokyo Kagaku Dojin (1986)).

The antibody of the present invention can be used as it is or after being labeled with a label.

Examples of the label include radioisotope, an affinity label (e.g., biotin, avidin, or the like), an enzyme label (e.g., horseradish peroxidase, alkaline phosphatase, or the like), a fluorescence label (e.g., FITC, rhodamine, or the like), a label using a rhodamine atom, (*J. Histochem. Cytochem.,* 18: 315 (1970); *Meth. Enzym.,* 62: 308 (1979); *Immunol.,* 109: 129 (1972); *J. Immunol., Meth.,* 13: 215 (1979)), and the like.

Expression of the polypeptide of the present invention, fluctuation of the expression, the presence or absence of structural change of the polypeptide, and the presence or absence in an organism other than coryneform bacteria of a polypeptide corresponding to the polypeptide can be analyzed using the antibody or the labeled antibody by the above assay, or a polypeptide array or proteome analysis described below.

Furthermore, the polypeptide recognized by the antibody can be purified by immunoaffinity chromatography using the antibody of the present invention.

12. Production and Use of Polypeptide Array (1) Production of Polypeptide Array

A polypeptide array can be produced using the polypeptide of the present invention obtained in the above item 10 or the antibody of the present invention obtained in the above item 11.

The polypeptide array of the present invention includes protein chips, and comprises a solid support and the polypeptide or antibody of the present invention adhered to the surface of the solid support.

Examples of the solid support include plastic such as polycarbonate or the like; an acrylic resin, such as polyacrylamide or the like; complex carbohydrates, such as agarose, sepharose, or the like; silica; a silica-based material, carbon, a metal, inorganic glass, latex beads, and the like.

The polypeptides or antibodies according to the present invention can be adhered to the surface of the solid support according to the method described in *Biotechniques,* 27: 1258-61 (1999); *Molecular Medicine Today,* 5: 326-7 (1999); *Handbook of Experimental Immunology,* 4th edition, Blackwell Scientific Publications, Chapter 10 (1986); *Meth. Enzym.,* 34 (1974); *Advances in Experimental Medicine and Biology,* 42 (1974); U.S. Pat. No. 4,681,870; U.S. Pat. No. 4,282,287; U.S. Pat. No. 4,762,881, or the like.

The analysis described herein can be efficiently performed by adhering the polypeptide or antibody of the present invention to the solid support at a high density, though a high fixation density is not always necessary.

(2) Use of Polypeptide Array

A polypeptide or a compound capable of binding to and interacting with the polypeptides of the present invention adhered to the array can be identified using the polypeptide array to which the polypeptides of the present invention have been adhered thereto as described in the above (1).

Specifically, a polypeptide or a compound capable of binding to and interacting with the polypeptides of the present invention can be identified by subjecting the polypeptides of the present invention to the following steps (i) to (iv):

(i) preparing a polypeptide array having the polypeptide of the present invention adhered thereto by the method of the above (1);

(ii) incubating the polypeptide immobilized on the polypeptide array together with at least one of a second polypeptide or compound;

(iii) detecting any complex formed between the at least one of a second polypeptide or compound and the polypeptide immobilized on the array using, for example, a label bound to the at least one of a second polypeptide or compound, or a secondary label which specifically binds to the complex or to a component of the complex after unbound material has been removed; and (iv) analyzing the detection data.

Specific examples of the polypeptide array to which the polypeptide of the present invention has been adhered include a polypeptide array containing a solid support to which at least one of a polypeptide containing an amino acid sequence selected from SEQ ID NOS:3502 to 7001, a polypeptide containing an amino acid sequence in which at least one amino acids is deleted, replaced, inserted or added in the amino acid sequence of the polypeptide and having substantially the same activity as that of the polypeptide, a polypeptide containing an amino acid sequence having a homology of 60% or more with the amino acid sequences of the polypeptide and having substantially the same activity as that of the polypeptides, a partial fragment polypeptide, and a peptide comprising an amino acid sequence of a part of a polypeptide.

The amount of production of a polypeptide derived from coryneform bacteria can be analyzed using a polypeptide array to which the antibody of the present invention has been adhered in the above (1).

Specifically, the expression amount of a gene derived from a mutant of coryneform bacteria can be analyzed by subjecting the gene to the following steps (i) to (iv):

(i) preparing a polypeptide array by the method of the above (1);

(ii) incubating the polypeptide array (the first antibody) together with a polypeptide derived from a mutant of coryneform bacteria;

(iii) detecting the polypeptide bound to the polypeptide immobilized on the array using a labeled second antibody of the present invention; and (iv) analyzing the detection data.

Specific examples of the polypeptide array to which the antibody of the present invention is adhered include a polypeptide array comprising a solid support to which at least one of an antibody which recognizes a polypeptide comprising an amino acid sequence selected from SEQ ID NOS:3502 to 7001, a polypeptide comprising an amino acid sequence in which at least one amino acids is deleted, replaced, inserted or added in the amino acid sequence of the polypeptide and having substantially the same activity as that of the polypeptide, a polypeptide comprising an amino acid sequence having a homology of 60% or more with the amino acid sequences of the polypeptide and having substantially the same activity as that of the polypeptides, a partial fragment polypeptide, or a peptide comprising an amino acid sequence of a part of a polypeptide.

A fluctuation in an expression amount of a specific polypeptide can be monitored using a polypeptide obtained in the time course of culture as the polypeptide derived from coryneform bacteria. The culturing conditions can be optimized by analyzing the fluctuation.

When a polypeptide derived from a mutant of coryneform bacteria is used, a mutated polypeptide can be detected.

13. Identification of Useful Mutation in Mutant by Proteome Analysis

Usually, the proteome is used herein to refer to a method wherein a polypeptide is separated by two-dimensional electrophoresis and the separated polypeptide is digested with an enzyme, followed by identification of the polypeptide using a mass spectrometer (MS) and searching a data base.

The two dimensional electrophoresis means an electrophoretic method which is performed by combining two electrophoretic procedures having different principles. For example, polypeptides are separated depending on molecular weight in the primary electrophoresis. Next, the gel is rotated by 90° or 180° and the secondary electrophoresis is carried out depending on isoelectric point. Thus, various separation patterns can be achieved (JIS K 3600 2474).

In searching the data base, the amino acid sequence information of the polypeptides of the present invention and the recording medium of the present invention provide for in the above items 2 and 8 can be used.

The proteome analysis of a coryneform bacterium and its mutant makes it possible to identify a polypeptide showing a fluctuation therebetween.

The proteome analysis of a wild type strain of coryneform bacteria and a production strain showing an improved productivity of a target product makes it possible to efficiently identify a mutation protein which is useful in breeding for improving the productivity of a target product or a protein of which expression amount is fluctuated.

Specifically, a wild type strain of coryneform bacteria and a lysine-producing strain thereof are each subjected to the proteome analysis. Then, a spot increased in the lysine-producing strain, compared with the wild type strain, is found and a data base is searched so that a polypeptide showing an increase in yield in accordance with an increase in the lysine productivity can be identified. For example, as a result of the proteome analysis on a wild type strain and a lysine-producing strain, the productivity of the catalase having the amino acid sequence represented by SEQ ID NO:3785 is increased in the lysine-producing mutant.

As a result that a protein having a high expression level is identified by proteome analysis using the nucleotide sequence information and the amino acid sequence information, of the genome of the coryneform bacteria of the present invention, and a recording medium storing the sequences, the nucleotide sequence of the gene encoding this protein and the nucleotide sequence in the upstream thereof can be searched at the same time, and thus, a nucleotide sequence having a high expression promoter can be efficiently selected.

In the proteome analysis, a spot on the two-dimentional electrophoresis gel showing a fluctuation is sometimes derived from a modified protein. However, the modified protein can be efficiently identified using the recording medium storing the nucleotide sequence information, the amino acid sequence information, of the genome of coryneform bacteria, and the recording medium storing the sequences, according to the present invention.

Moreover, a useful mutation point in a useful mutant can be easily specified by searching a nucleotide sequence (nucleotide sequence of promoters, ORF, or the like) relating to the thus identified protein using a recording medium storing the nucleotide sequence information and the amino acid sequence information, of the genome of coryneform bacteria of the present invention, and a recording medium storing the sequences and using a primer designed on the basis of the detected nucleotide sequence. As a result that the useful mutation point is specified, an industrially useful mutant having the useful mutation or other useful mutation derived therefrom can be easily bred.

The present invention will be explained in detail below based on Examples. However, the present invention is not limited thereto.

EXAMPLE 1

Determination of the Full Nucleotide Sequence of Genome of *Corynebacterium glutamicum*

The full nucleotide sequence of the genome of *Corynebacterium glutamicum* was determined based on the whole genome shotgun method (*Science*, 269: 496-512 (1995)). In this method, a genome library was prepared and the terminal sequences were determined at random. Subsequently, these sequences were ligated on a computer to cover the full genome. Specifically, the following procedure was carried out.

(1) Preparation of Genome DNA of *Corynebacterium glutamicum* ATCC 13032

*Corynebacterium glutamicum* ATCC 13032 was cultured in BY medium (7 g/l meat extract, 10 g/l peptone, 3 g/l sodium chloride, 5 g/l yeast extract, pH 7.2) containing 1% of glycine at 30° C. overnight and the cells were collected by centrifugation. After washing with STE buffer (10.3% sucrose, 25 mmol/l Tris hydrochloride, 25 mmol/l EDTA, pH 8.0), the cells were suspended in 10 ml of STE buffer containing 10 mg/ml lysozyme, followed by gently shaking at 37° C. for 1 hour. Then, 2 ml of 10% SDS was added thereto to lyse the cells, and the resultant mixture was maintained at 65° C. for 10 minutes and then cooled to room temperature. Then, 10 ml of Tris-neutralized phenol was added thereto, followed by gently shaking at room temperature for 30 minutes and centrifugation (15,000×g, 20 minutes, 20° C.). The aqueous layer was separated and subjected to extraction with phenol/chloroform and extraction with chloroform (twice) in the same manner. To the aqueous layer, 3 mol/l sodium acetate solution (pH 5.2) and isopropanol were added at 1/10 times volume and twice volume, respectively, followed by gently stirring to precipitate the genome DNA. The genome DNA was dissolved again in 3 ml of TE buffer (10 mmol/l Tris hydrochloride, 1 mmol/l EDTA, pH 8.0) containing 0.02 mg/ml of RNase and maintained at 37° C. for 45 minutes. The extractions with phenol, phenol/chloroform and chloroform were carried out successively in the same manner as the above. The genome DNA was subjected to isopropanol precipitation. The thus formed genome DNA precipitate was washed with 70% ethanol three times, followed by air-drying, and dissolved in 1.25 ml of TE buffer to give a genome DNA solution (concentration: 0.1 mg/ml).

(2) Construction of a Shotgun Library

TE buffer was added to 0.01 mg of the thus prepared genome DNA of *Corynebacterium glutamicum* ATCC 13032 to give a total volume of 0.4 ml, and the mixture was treated with a sonicator (Yamato Powersonic Model 150) at an output of 20 continuously for 5 seconds to obtain fragments of 1 to 10 kb. The genome fragments were blunt-ended using a DNA blunting kit (manufactured by Takara Shuzo) and then fractionated by 6% polyacrylamide gel electrophoresis. Genome fragments of 1 to 2 kb were cut out from the gel, and 0.3 ml MG elution buffer (0.5 mol/l ammonium acetate, 10 mmol/l magnesium acetate, 1 mmol/l EDTA, 0.1% SDS) was added thereto, followed by shaking at 37° C. overnight to elute DNA. The DNA eluate was treated with phenol/chloroform, and then precipitated with ethanol to obtain a genome library insert. The total insert and 500 ng of pUC18 SmaI/BAP (manufactured by Amersham Pharmacia Biotech) were ligated at 16° C. for 40 hours.

The ligation product was precipitated with ethanol and dissolved in 0.01 ml of TE buffer. The ligation solution (0.001 ml) was introduced into 0.04 ml of *E. coli* ELECTRO MAX DH10B (manufactured by Life Technologies) by the electroporation under conditions according to the manufacture's instructions. The mixture was spread on LB plate medium (LB medium (10 g/l bactotrypton, 5 g/l yeast extract, 10 g/l sodium chloride, pH 7.0) containing 1.6% of agar) containing 0.1 mg/ml ampicillin, 0.1 mg/ml X-gal and 1 mmol/l isopropyl-β-D-thiogalactopyranoside (IPTG) and cultured at 37° C. overnight.

The transformant obtained from colonies formed on the plate medium was stationarily cultured in a 96-well titer plate having 0.05 ml of LB medium containing 0.1 mg/ml ampicillin at 37° C. overnight. Then, 0.05 ml of LB medium containing 20% glycerol was added thereto, followed by stirring to obtain a glycerol stock.

(3) Construction of Cosmid Library

About 0.1 mg of the genome DNA of *Corynebacterium glutamicum* ATCC 13032 was partially digested with Sau3AI (manufactured by Takara Shuzo) and then ultracentrifuged (26,000 rpm, 18 hours, 20° C.) under 10 to 40% sucrose density gradient obtained using 10% and 40% sucrose buffers (1 mol/l NaCl, 20 mmol/l Tris hydrochloride, 5 mmol/l EDTA, 10% or 40% sucrose, pH 8.0). After the centrifugation, the solution thus separated was fractionated into tubes at 1 ml in each tube. After confirming the DNA fragment length of each fraction by agarose gel electrophoresis, a fraction containing a large amount of DNA fragment of about 40 kb was precipitated with ethanol.

The DNA fragment was ligated to the BamHI site of superCos1 (manufactured by Stratagene) in accordance with the manufacture's instructions. The ligation product was incorporated into *Escherichia coli* XL-1-BlueMR strain (manufactured by Stratagene) using Gigapack III Gold Packaging Extract (manufactured by Stratagene) in accordance with the manufacture's instructions. The *Escherichia coli* was spread on LB plate medium containing 0.1 mg/ml ampicillin and cultured therein at 37° C. overnight to isolate colonies. The resulting colonies were stationarily cultured at 37° C. overnight in a 96-well titer plate containing 0.05 ml of the LB medium containing 0.1 mg/ml ampicillin in each well. LB medium containing 20% glycerol (0.05 ml) was added thereto, followed by stirring to obtain a glycerol stock.

(4) Determination of Nucleotide Sequence (4-1) Preparation of Template

The full nucleotide sequence of *Corynebacterium glutamicum* ATCC 13032 was determined mainly based on the whole genome shotgun method. The template used in the whole genome shotgun method was prepared by the PCR-method using the library prepared in the above (2).

Specifically, the clone derived from the whole genome shotgun library was inoculated using a replicator (manufactured by GENETIX) into each well of a 96-well plate containing the LB medium containing 0.1 mg/ml of ampicillin at 0.08 ml per each well and then stationarily cultured at 37° C. overnight.

Next, the culturing solution was transported using a copy plate (manufactured by Tokken) into a 96-well reaction plate (manufactured by PE Biosystems) containing a PCR reaction solution (TaKaRa Ex Taq (manufactured by Takara Shuzo)) at 0.08 ml per each well. Then, PCR was carried out in accordance with the protocol by Makino et. al. (*DNA Research*, 5: 1-9 (1998)) using GeneAmp PCR System 9700 (manufactured by PE Biosystems) to amplify the inserted fragment.

The excessive primers and nucleotides were eliminated using a kit for purifying a PCR production (manufactured by Amersham Pharmacia Biotech) and the residue was used as the template in the sequencing reaction.

Some nucleotide sequences were determined using a double-stranded DNA plasmid as a template.

The double-stranded DNA plasmid as the template was obtained by the following method.

The clone derived from the whole genome shotgun library was inoculated into a 24- or 96-well plate containing a 2× YT medium (16 g/l bactotrypton, 10 g/l yeast extract, 5 g/l sodium chloride, pH 7.0) containing 0.05 mg/ml ampicillin at 1.5 ml per each well and then cultured under shaking at 37° C. overnight.

The double-stranded DNA plasmid was prepared from the culturing solution using an automatic plasmid preparing machine, KURABO PI-50 (manufactured by Kurabo Industries) or a multiscreen (manufactured by Millipore) in accordance with the protocol provided by the manufacturer.

To purify the double-stranded DNA plasmid using the multiscreen, Biomek 2000 (manufactured by Beckman Coulter) or the like was employed.

The thus obtained double-stranded DNA plasmid was dissolved in water to give a concentration of about 0.1 mg/ml and used as the template in sequencing.

(4-2) Sequencing Reaction

To 6 μl of a solution of ABI PRISM BigDye Terminator Cycle Sequencing Ready Reaction Kit (manufactured by PE Biosystems), an M13 regular direction primer (M13-21) or an M13 reverse direction primer (M13REV) (*DNA Research*, 5: 1-9 (1998) and the template prepared in the above (4-1) (the PCR product or the plasmid) were added to give 10 μl of a sequencing reaction solution. The primers and the templates were used in an amount of 1.6 pmol and an amount of 50 to 200 ng, respectively.

Dye terminator sequencing reaction of 45 cycles was carried out with GeneAmp PCR System 9700 (manufactured by PE Biosystems) using the reaction solution. The cycle parameter was determined in accordance with the manufacturer's instruction accompanying ABI PRISM BigDye Terminator Cycle Sequencing Ready Reaction Kit. The sample was purified using MultiScreen HV plate (manufactured by Millipore) according to the manufacture's instructions. The thus purified reaction product was precipitated with ethanol, followed by drying, and then stored in the dark at −30° C.

The dry reaction product was analyzed by ABI PRISM 377 DNA Sequencer and ABI PRISM 3700 DNA Analyzer (both manufactured by PE Biosystems) each in accordance with the manufacture's instructions.

The data of about 50,000 sequences in total (i.e., about 42,000 sequences obtained using 377 DNA Sequencer and about 8,000 reactions obtained by 3700 DNA Analyser) were transferred to a server (Alpha Server 4100: manufactured by COMPAQ) and stored. The data of these about 50,000 sequences corresponded to 6 times as much as the genome size.

(5) Assembly

All operations were carried out on the basis of UNIX platform. The analytical data were output in Macintosh platform using X Window System. The base call was carried out using phred (The University of Washington). The vector sequence data was deleted using SPS Cross_Match (manufactured by Southwest Parallel Software). The assembly was carried out using SPS phrap (manufactured by Southwest Parallel Software; a high-speed version of phrap (The University of Washington)). The contig obtained by the assembly was analyzed using a graphical editor, consed (The University of Washington). A series of the operations from the base call to the assembly were carried out simultaneously using a script phredPhrap attached to consed.

(6) Determination of Nucleotide Sequence in Gap Part

Each cosmid in the cosmid library constructed in the above (3) was prepared by a method similar to the preparation of the double-stranded DNA plasmid described in the above (4-1). The nucleotide sequence at the end of the inserted fragment of the cosmid was determined by using ABI PRISM BigDye Terminator Cycle Sequencing Ready Reaction Kit (manufactured by PE Biosystems) according to the manufacture's instructions.

About 800 cosmid clones were sequenced at both ends to search a nucleotide sequence in the contig derived from the shotgun sequencing obtained in the above (5) coincident with the sequence. Thus, the linkage between respective cosmid clones and respective contigs were determined and mutual alignment was carried out. Furthermore, the results were compared with the physical map of *Corynebacterium glutamicum* ATCC 13032 (*Mol. Gen. Genet.*, 252: 255-265 (1996) to carrying out mapping between the cosmids and the contigs.

The sequence in the region which was not covered with the contigs was determined by the following method.

Clones containing sequences positioned at the ends of contigs were selected. Among these clones, about 1,000 clones wherein only one end of the inserted fragment had been determined were selected and the sequence at the opposite end of the inserted fragment was determined. A shotgun library clone or a cosmid clone containing the sequences at the respective ends of the inserted fragment in two contigs was identified, the full nucleotide sequence of the inserted fragment of this clone was determined, and thus the nucleotide sequence of the gap part was determined.

When no shotgun library clone or cosmid clone covering the gap part was available, primers complementary to the end sequences at the two contigs were prepared and the DNA fragment in the gap part was amplified by PCR. Then, sequencing was performed by the primer walking method using the amplified DNA fragment as a template or by the shotgun method in which the sequence of a shotgun clone prepared from the amplified DNA fragment was determined. Thus, the nucleotide sequence of the domain was determined.

In a region showing a low sequence precision, primers were synthesized using AUTOFINISH function and NAVIGATING function of consed (The University of Washington) and the sequence was determined by the primer walking method to improve the sequence precision. The thus determined full nucleotide sequence of the genome of *Corynebacterium glutamicum* ATCC 13032 strain is shown in SEQ ID NO:1.

(7) Identification of ORF and Presumption of its Function

ORFs in the nucleotide sequence represented by SEQ ID NO:1 were identified according to the following method. First, the ORF regions were determined using software for identifying ORF, i.e., Glimmer, GeneMark and GeneMark.hmm on UNIX platform according to the respective manual attached to the software.

Based on the data thus obtained, ORFs in the nucleotide sequence represented by SEQ ID NO:1 were identified.

The putative function of an ORF was determined by searching the homology of the identified amino acid sequence of the ORF against an amino acid database consisting of protein-encoding domains derived from Swiss-Prot, PIR or Genpept database constituted by protein encoding domains derived from GenBank database, Frame Search (manufactured by Compugen), or by searching the homology of the identified amino acid sequence of the ORF against an amino acid database consisting of protein-encoding domains derived from Swiss-Prot, PIR or Genpept database constituted by protein encoding domains derived from GenBank database, BLAST. The nucleotide sequences of the thus determined ORFs are shown in SEQ ID NOS:2 to 3501, and the amino acid sequences encoded by these ORFs are shown in SEQ ID NOS:3502 to 7001.

In some cases of the sequence listings in the present invention, nucleotide sequences, such as TTG, TGT, GGT, and the like, other than ATG, are read as an initiating codon encoding Met.

Also, the preferred nucleotide sequences are SEQ ID NOS:2 to 355 and 357 to 3501, and the preferred amino acid sequences are shown in SEQ ID NOS:3502 to 3855 and 3957 to 7001

Table 1 shows the registration numbers in the above-described databases of sequences which were judged as having the highest homology with the nucleotide sequences of the ORFs as the results of the homology search in the amino acid sequences using the homology-searching software Frame Search (manufactured by Compugen), names of the genes of these sequences, the functions of the genes, and the matched length, identities and analogies compared with publicly known amino acid translation sequences. Moreover, the corresponding positions were confirmed via the alignment of the nucleotide sequence of an arbitrary ORF with the nucleotide sequence of SEQ ID NO:1. Also, the positions of nucleotide sequences other than the ORFs (for example, ribosomal RNA genes, transfer RNA genes, IS sequences, and the like) on, the genome were determined.

FIG. 1 shows the positions of typical genes of the *Corynebacterium glutamicum* ATCC 13032 on the genome.

TABLE 1

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2 | 3502 | 1 | 1572 | 1572 | gsp: R98523 | Brevibacterium flavum dnaA | 99.8 | 99.8 | 524 | replication initiation protein DnaA |
| 3 | 3503 | 1920 | 1597 | 324 | | | | | | |
| 4 | 3504 | 2292 | 3473 | 1182 | sp: DP3B_MYCSM | Mycobacterium smegmatis dnaN | 50.5 | 81.8 | 390 | DNA polymerase III beta chain |
| 5 | 3505 | 3585 | 4766 | 1182 | sp: RECF_MYCSM | Mycobacterium smegmatis recF | 53.3 | 79.9 | 392 | DNA replication protein (recF protein) |
| 6 | 3506 | 4766 | 5299 | 534 | sp: YREG_STRCO | Streptomyces coelicolor yreG | 35.1 | 58.1 | 174 | hypothetical protein |
| 7 | 3507 | 5354 | 7486 | 2133 | pir: S44198 | Mycobacterium tuberculosis H37Rv gyrB | 71.9 | 88.9 | 704 | DNA topoisomerase (ATP-hydrolyzing) |
| 8 | 3508 | 7830 | 8795 | 966 | | | | | | |
| 9 | 3509 | 9466 | 8798 | 669 | | | | | | |
| 10 | 3510 | 9562 | 10071 | 510 | | | | | | |
| 11 | 3511 | 9914 | 9474 | 441 | | | | | | |
| 12 | 3512 | 11177 | 10107 | 1071 | sp: YV11_MYCTU | Mycobacterium tuberculosis H37Rv | 29.4 | 50.7 | 422 | NAGC/XYLR repressor |
| 13 | 3513 | 11523 | 11263 | 261 | | | | | | |
| 14 | 3514 | 11768 | 11523 | 246 | | | | | | |
| 15 | 3515 | 11831 | 14398 | 2568 | sp: GYRA_MYCTU | Mycobacterium tuberculosis H37Rv Rv0006 gyrA | 70.4 | 88.1 | 854 | DNA gyrase subunit A |
| 16 | 3516 | 14405 | 14746 | 342 | pir: E70698 | Mycobacterium tuberculosis H37Rv Rv0007 | 29.5 | 69.6 | 112 | hypothetical membrane protein |
| 17 | 3517 | 16243 | 15209 | 1035 | sp: YEIH_ECOLI | Escherichia coli K12 yeiH | 33.7 | 63.5 | 329 | hypothetical protein |
| 18 | 3518 | 16314 | 17207 | 894 | gp: AB042619_1 | Hydrogenophilus thermoluteolus TH-1 cbbR | 27.6 | 62.3 | 268 | bacterial regulatory protein, LysR type |
| 19 | 3519 | 17251 | 17670 | 420 | | | | | | |
| 20 | 3520 | 18729 | 17860 | 870 | gp: AF156103_2 | Rhodobacter capsulatus ccdA | 29.1 | 57.4 | 265 | cytochrome c biogenesis protein |
| 21 | 3521 | 19497 | 18736 | 762 | pir: A49232 | Coxiella burnetii com1 | 31.6 | 64.5 | 155 | hypothetical protein |
| 22 | 3522 | 19705 | 20073 | 369 | pir: F70664 | Mycobacterium tuberculosis H37Rv Rv1846c | 36.8 | 70.1 | 117 | repressor |
| 23 | 3523 | 20073 | 21065 | 993 | gp: MLCB1788_6 | Mycobacterium leprae MLCB1788.18 | 24.9 | 50.8 | 321 | hypothetical membrane protein |
| 24 | 3524 | 21253 | 21074 | 180 | pir: I40838 | Corynebacterium sp. ATCC 31090 | 65.4 | 88.5 | 26 | 2,5-diketo-D-gluconic acid reductase |
| 25 | 3525 | 21597 | 22124 | 528 | sp: 5NTD_VIBPA | Vibrio parahaemolyticus nutA | 27.0 | 56.1 | 196 | 5′-nucleotidase precursor |
| 26 | 3526 | 22164 | 23399 | 1236 | gp: AE001909_7 | Deinococcus radiodurans DR0505 | 27.0 | 56.7 | 270 | 5′-nucleotidase family protein |
| 27 | 3527 | 23779 | 23615 | 165 | prf: 2513302C | Corynebacterium striatum ORF1 | 52.9 | 72.6 | 51 | transposase |
| 28 | 3528 | 24295 | 24729 | 435 | prf: 2413353A | Xanthomonas campestris phaseoli ohr | 51.8 | 79.9 | 139 | organic hydroperoxide detoxication enzyme |
| 29 | 3529 | 26297 | 24885 | 1413 | sp: RECG_THIFE | Thiobacillus ferrooxidans recG | 32.7 | 60.8 | 217 | ATP-dependent DNA helicase |
| 30 | 3530 | 26338 | 26775 | 438 | | | | | | |
| 31 | 3531 | 28099 | 26822 | 1278 | sp: AMYH_YEAST | Saccharomyces cerevisiae S288C YIR019C sta1 | 26.7 | 54.1 | 449 | glucan 1,4-alpha-glucosidase |
| 32 | 3532 | 29117 | 28164 | 954 | gp: ERU52850_1 | Erysipelothrix rhusiopathiae ewlA | 28.9 | 63.7 | 311 | lipoprotein |
| 33 | 3533 | 29965 | 29117 | 849 | gp: AF180520_3 | Streptococcus pyogenes SF370 mtsC | 34.6 | 74.1 | 266 | ABC 3 transport family or integral membrane protein |
| 34 | 3534 | 29995 | 30651 | 657 | sp: FECE_ECOLI | Escherichia coli K12 fecE | 39.2 | 70.3 | 222 | iron(III) dicitrate transport ATP-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 35 | 3535 | 30697 | 31677 | 981 | pir: A72417 | *Thermotoga maritima* MSB8 TM0114 | 25.8 | 56.5 | 283 | sugar ABC transporter, periplasmic sugar-binding protein |
| 36 | 3536 | 31677 | 32699 | 1023 | prf: 1207243B | *Escherichia coli* K12 rbsC | 30.5 | 68.3 | 312 | high affinity ribose transport protein |
| 37 | 3537 | 32699 | 33457 | 759 | sp: RBSA_BACSU | *Bacillus subtilis* 168 rbsA | 32.2 | 76.7 | 236 | ribose transport ATP-binding protein |
| 38 | 3538 | 34280 | 33465 | 816 | pir: I51116 | *Petromyzon marinus* | 23.6 | 44.4 | 347 | neurofilament subunit NF-180 |
| 39 | 3539 | 34339 | 34899 | 561 | sp: CYPA_MYCTU | *Mycobacterium leprae* H37RV RV0009 ppiA | 79.9 | 89.9 | 169 | peptidyl-prolyl cis-trans Isomerase A |
| 40 | 3540 | 34982 | 35668 | 687 | sp: YQGP_BACSU | *Bacillus subtilis* 168 yqgP | 29.2 | 53.1 | 226 | hypothetical membrane protein |
| 41 | 3541 | 37221 | 38198 | 978 | sp: FEPG_ECOLI | *Escherichia coli* K12 fepG | 40.4 | 70.5 | 332 | ferric enterobactin transport system permease protein |
| 42 | 3542 | 37242 | 36247 | 996 | | | | | | ATPase |
| 43 | 3543 | 38202 | 38978 | 777 | gp: VCU52150_9 | *Vibrio cholerae* viuC | 51.8 | 81.8 | 253 | vulnibactin utilization protein |
| 44 | 3544 | 38978 | 39799 | 822 | sp: VIUB_VIBVU | *Vibrio vulnificus* MO6-24 viuB | 26.2 | 52.7 | 260 | hypothetical membrane protein |
| 45 | 3545 | 40458 | 40189 | 270 | sp: YO11_MYCTU | *Mycobacterium tuberculosis* H37Rv Rv0011c | 40.0 | 72.6 | 95 | |
| 46 | 3546 | 42513 | 40576 | 1938 | sp: PKNB_MYCLE | *Mycobacterium leprae* pknB | 40.6 | 68.7 | 648 | serine/threonine protein kinase |
| 47 | 3547 | 43919 | 42513 | 1407 | gp: AF094711_1 | *Streptomyces coelicolor* pksC | 31.7 | 59.1 | 486 | serine/threonine protein kinase |
| 48 | 3548 | 45347 | 43926 | 1422 | gp: AF241575_1 | *Streptomyces griseus* pbpA | 33.5 | 66.7 | 492 | penicillin-binding protein |
| 49 | 3549 | 46489 | 45347 | 1143 | sp: SP5E_BACSU | *Bacillus subtilis* 168 spoVE | 31.2 | 65.6 | 375 | stage V sporulation protein E |
| 50 | 3550 | 48021 | 46669 | 1353 | pir: H70699 | *Mycobacterium tuberculosis* H37Rv ppp | 44.1 | 70.8 | 469 | phosphoprotein phosphatase |
| 51 | 3551 | 48485 | 48024 | 462 | pir: A70700 | *Mycobacterium tuberculosis* H37Rv Rv0019c | 38.7 | 66.5 | 155 | hypothetical protein |
| 52 | 3552 | 49368 | 48505 | 864 | pir: B70700 | *Mycobacterium tuberculosis* H37Rv Rv0020c | 23.6 | 38.8 | 526 | hypothetical protein |
| 53 | 3553 | 49601 | 49455 | 147 | | | | | | |
| 54 | 3554 | 50616 | 49897 | 720 | | | | | | |
| 55 | 3555 | 50972 | 50754 | 219 | | | | | | |
| 56 | 3556 | 51436 | 50966 | 471 | | | | | | |
| 57 | 3557 | 53055 | 54008 | 954 | sp: PH2M_TRICU | *Trichosporon cutaneum* ATCC 46490 | 29.9 | 63.3 | 117 | phenol 2-monooxygenase |
| 58 | 3558 | 53095 | 51626 | 1470 | sp: GABD_ECOLI | *Escherichia coli* K12 gabD | 46.7 | 78.2 | 490 | succinate-semialdehyde dehydrogenase (NAD(P)+) |
| 59 | 3559 | 54080 | 55546 | 1467 | sp: YRKH_BACSU | *Bacillus subtilis* yrkH | 27.3 | 57.0 | 242 | hypothetical membrane protein |
| 60 | 3560 | 56417 | 55629 | 789 | sp: Y441_METJA | *Methanococcus jannaschii* MJ0441 | 29.0 | 64.1 | 262 | hypothetical membrane protein |
| 61 | 3561 | 56676 | 56386 | 291 | sp: YRKF_BACSU | *Bacillus subtilis* yrkF | 40.5 | 74.3 | 74 | hypothetical protein |
| 62 | 3562 | 57270 | 56680 | 591 | sp: YC6L_SYNY3 | *Synechocystis* sp. PCC6803 slr1261 | 36.3 | 70.4 | 179 | hypothetical protein |
| 63 | 3563 | 57478 | 57651 | 174 | pir: G70988 | *Mycobacterium tuberculosis* H37Rv Rv1766 | 53.2 | 83.9 | 62 | hypothetical protein |
| 64 | 3564 | 58087 | 58941 | 855 | | | | | | |
| 65 | 3565 | 59091 | 59930 | 840 | gp: LMFL4768_11 | *Leishmania major* L4768.11 | 26.8 | 50.7 | 310 | hypothetical protein |
| 66 | 3566 | 59952 | 60662 | 711 | | | | | | |
| 67 | 3567 | 60669 | 62321 | 1653 | | | | | | |
| 68 | 3568 | 63508 | 62390 | 1119 | pir: F70952 | *Mycobacterium tuberculosis* H37Rv Rv1239c corA | 29.5 | 59.5 | 390 | magnesium and cobalt transport protein |
| 69 | 3569 | 64040 | 63594 | 447 | | | | | | |
| 70 | 3570 | 64190 | 65458 | 1269 | gp: AF179611_12 | *Zymomonas mobilis* ZM4 clcb | 30.0 | 64.8 | 400 | chloride channel protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 71 | 3571 | 66197 | 65508 | 690 | sp: PNUC_SALTY | Salmonella typhimurium pnuC | 24.1 | 53.1 | 241 | required for NMN transport |
| 72 | 3572 | 66851 | 67972 | 1122 | sp: PHOL_MYCTU | Mycobacterium tuberculosis H37Rv RV2368C | 29.1 | 60.0 | 340 | phosphate starvation-induced protein-like protein |
| 73 | 3573 | 68170 | 68301 | 132 | | | | | | |
| 74 | 3574 | 68634 | 68251 | 384 | | | | | | |
| 75 | 3575 | 69060 | 69824 | 765 | | | | | | |
| 76 | 3576 | 70186 | 68720 | 1467 | sp: CITM_BACSU | Bacillus subtilis citM | 42.3 | 68.8 | 497 | Mg(2+)/citrate complex secondary transporter |
| 77 | 3577 | 70506 | 72158 | 1653 | sp: DPIB_ECOLI | Escherichia coli K12 dpiB | 27.2 | 60.6 | 563 | two-component system sensor histidine kinase |
| 78 | 3578 | 72043 | 71474 | 570 | sp: DPIA_ECOLI | Escherichia coli K12 criR | 33.2 | 63.3 | 229 | transcriptional regulator |
| 79 | 3579 | 72161 | 72814 | 654 | gp: AF134895_1 | Corynebacterium glutamicum unkdh | 43.3 | 73.7 | 293 | D-isomer specific 2-hydroxyacid dehydrogenase |
| 80 | 3580 | 73728 | 72817 | 912 | | | | | | |
| 81 | 3581 | 73844 | 74272 | 429 | gp: SCM2_3 | Streptomyces coelicolor A3(2) SCM2.03 | 38.6 | 76.4 | 127 | hypothetical protein |
| 82 | 3582 | 74490 | 75491 | 1002 | sp: BIOB_CORGL | Corynebacterium glutamicum bioB | 99.4 | 99.7 | 334 | biotin synthase |
| 83 | 3583 | 75506 | 75742 | 237 | pir: H70542 | Mycobacterium tuberculosis H37Rv Rv1590 | 72.1 | 79.1 | 43 | hypothetical protein |
| 84 | 3584 | 75697 | 76035 | 339 | sp: YKI4_YEAST | Saccharomyces cerevisiae YKL084w | 34.1 | 63.5 | 85 | hypothetical protein |
| 85 | 3585 | 76353 | 76469 | 117 | | | | | | |
| 86 | 3586 | 80753 | 80613 | 141 | PIR: F81737 | Chlamydia muridarum Nigg TC0129 | 71.0 | 75.0 | 42 | hypothetical protein |
| 87 | 3587 | 81274 | 81002 | 273 | GSP: Y35814 | Chlamydia pneumoniae | 61.0 | 66.0 | 84 | hypothetical protein |
| 88 | 3588 | 83568 | 82120 | 1449 | prf: 2512333A | Streptomyces virginiae varS | 25.6 | 59.0 | 507 | Integral membrane efflux protein |
| 89 | 3589 | 84935 | 83691 | 1245 | gp: D38505_1 | Bacillus sp. | 97.2 | 99.8 | 394 | creatinine deaminase |
| 90 | 3590 | 85403 | 85098 | 306 | | | | | | |
| 91 | 3591 | 86277 | 85663 | 615 | | | | | | |
| 92 | 3592 | 86318 | 87241 | 924 | sp: HST2_YEAST | Saccharomyces cerevisiae hst2 | 26.2 | 50.2 | 279 | SIR2 gene family (silent information regulator) |
| 93 | 3593 | 88532 | 87561 | 972 | prf: 2316378A | Propionibacterium acnes | 30.7 | 59.0 | 251 | triacylglycerol lipase |
| 94 | 3594 | 89444 | 88545 | 900 | prf: 2316378A | Propionibacterium acnes | 29.4 | 56.1 | 262 | triacylglycerol lipase |
| 95 | 3595 | 89558 | 90445 | 888 | | | | | | |
| 96 | 3596 | 90973 | 90461 | 513 | gp: AB029154_1 | Corynebacterium glutamicum ureR | 90.6 | 94.7 | 171 | transcriptional regulator |
| 97 | 3597 | 91174 | 91473 | 300 | gp: AB029154_2 | Corynebacterium glutamicum ureA | 100.0 | 100.0 | 100 | urease gamma subunit or urease structural protein |
| 98 | 3598 | 91503 | 91988 | 486 | gp: CGL251883_2 | Corynebacterium glutamicum ATCC 13032 ureB | 100.0 | 100.0 | 162 | urease beta subunit |
| 99 | 3599 | 91992 | 93701 | 1710 | gp: CGL251883_3 | Corynebacterium glutamicum ATCC 13032 ureC | 100.0 | 100.0 | 570 | urease alpha subunit |
| 100 | 3600 | 93729 | 94199 | 471 | gp: CGL251883_4 | Corynebacterium glutamicum ATCC 13032 ureE | 100.0 | 100.0 | 157 | urease accessory protein |
| 101 | 3601 | 94202 | 94879 | 678 | gp: CGL251883_5 | Corynebacterium glutamicum ATCC 13032 ureF | 100.0 | 100.0 | 226 | urease accessory protein |
| 102 | 3602 | 94899 | 95513 | 615 | gp: CGL251883_6 | Corynebacterium glutamicum ATCC 13032 ureG | 100.0 | 100.0 | 205 | urease accessory protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 103 | 3603 | 95517 | 96365 | 849 | gp: CGL251883_7 | *Corynebacterium glutamicum* ATCC 13032 ureD | 100.0 | 100.0 | 283 | urease accessory protein |
| 104 | 3604 | 97144 | 96368 | 777 | prf: 2318326B | *Agrobacterium radiobacter* echA | 21.2 | 48.4 | 279 | epoxide hydrolase |
| 105 | 3605 | 97521 | 98189 | 669 | | | | | | |
| 106 | 3606 | 98470 | 97319 | 1152 | gp: AF148322_1 | *Streptomyces viridifaciens* vlmF | 26.5 | 59.7 | 347 | valanimycin resistant protein |
| 107 | 3607 | 99819 | 100493 | 675 | | | | | | |
| 108 | 3608 | 101582 | 98808 | 2775 | | | | | | |
| 109 | 3609 | 103435 | 101612 | 1824 | sp: HTPG_ECOLI | *Escherichia coli* K12 htpG | 23.8 | 52.7 | 668 | heat shock protein (hsp90-family) |
| 110 | 3610 | 103494 | 104909 | 1416 | sp: AMN_ECOLI | *Escherichia coli* K12 amn | 41.0 | 68.2 | 481 | AMP nucleosidase |
| 111 | 3611 | 105751 | 105173 | 579 | | | | | | |
| 112 | 3612 | 106392 | 105841 | 552 | pir: E72483 | *Aeropyrum pernix* K1 APE2509 | 29.6 | 58.7 | 196 | acetolactate synthase large subunit |
| 113 | 3613 | 107289 | 106630 | 660 | | | | | | |
| 114 | 3614 | 107435 | 110890 | 3456 | sp: PUTA_SALTY | *Salmonella typhimurium* putA | 25.8 | 50.4 | 1297 | proline dehydrogenase/P5C dehydrogenase |
| 115 | 3615 | 111161 | 111274 | 114 | | | | | | |
| 116 | 3616 | 111374 | 112318 | 945 | sp: AAD_PHACH | *Phanerochaete chrysosporium* aad | 30.2 | 60.7 | 338 | aryl-alcohol dehydrogenase (NADP+) |
| 117 | 3617 | 112470 | 114083 | 1614 | sp: YDAH_ECOLI | *Escherichia coli* K12 ydaH | 36.5 | 71.4 | 513 | pump protein (transport) |
| 118 | 3618 | 114147 | 115478 | 1332 | prf: 2422424A | *Enterobacter agglomerans* | 23.0 | 49.2 | 352 | Indole-3-acetyl-Asp hydrolase |
| 119 | 3619 | 115262 | 114564 | 699 | | | | | | |
| 120 | 3620 | 115578 | 115943 | 366 | sp: YIDH_ECOLI | *Escherichia coli* K12 yidH | 35.9 | 70.8 | 106 | hypothetical membrane protein |
| 121 | 3621 | 115949 | 116263 | 315 | | | | | | |
| 122 | 3622 | 118599 | 116548 | 2052 | | | | | | |
| 123 | 3623 | 119589 | 118810 | 780 | sp: ACCR_AGRTU | *Agrobacterium tumefaciens* accR | 29.5 | 59.7 | 258 | transcriptional repressor |
| 124 | 3624 | 120021 | 120410 | 390 | pir: C70019 | *Bacillus subtilis* yurT | 57.9 | 78.6 | 126 | methylglyoxalase |
| 125 | 3625 | 120922 | 120413 | 510 | sp: YC76_MYCTU | *Mycobacterium tuberculosis* H37Rv Rv1276c | 37.0 | 64.8 | 162 | hypothetical protein |
| 126 | 3626 | 122459 | 120951 | 1509 | prf: 2309180A | *Pseudomonas fluorescens* mtlD | 43.5 | 70.4 | 497 | mannitol dehydrogenase |
| 127 | 3627 | 123841 | 122507 | 1335 | prf: 2321326A | *Klebsiella pneumoniae* dalT | 30.3 | 68.3 | 435 | D-arabinitol transporter |
| 128 | 3628 | 123842 | 124030 | 189 | | | | | | |
| 129 | 3629 | 124130 | 124966 | 837 | sp: GATR_ECOLI | *Escherichia coli* K12 gatR | 27.3 | 64.6 | 260 | galactitol utilization operon repressor |
| 130 | 3630 | 124932 | 126350 | 1419 | sp: XYLB_STRRU | *Streptomyces rubiginosus* xylB | 45.0 | 68.1 | 451 | xylulose kinase |
| 131 | 3631 | 127171 | 127992 | 822 | | | | | | |
| 132 | 3632 | 127189 | 126353 | 837 | gp: CGPAN_2 | *Corynebacterium glutamicum* ATCC 13032 panC | 100.0 | 100.0 | 279 | pantoate-beta-alanine ligase |
| 133 | 3633 | 128004 | 127192 | 813 | gp: CGPAN_1 | *Corynebacterium glutamicum* ATCC 13032 panB | 100.0 | 100.0 | 271 | 3-methyl-2-oxobutanoate hydroxymethyltransferase |
| 134 | 3634 | 129049 | 128099 | 951 | | | | | | |
| 135 | 3635 | 130118 | 129489 | 630 | sp: 3MG_ARATH | *Arabidopsis thaliana* mag | 42.0 | 67.6 | 188 | DNA-3-methyladenine glycosylase |
| 136 | 3636 | 130145 | 130798 | 654 | | | | | | |
| 137 | 3637 | 131738 | 130815 | 924 | gp: AB029896_1 | Petroleum-degrading bacterium HD-1 hde | 39.3 | 69.3 | 270 | esterase |
| 138 | 3638 | 131798 | 132424 | 627 | | | | | | |
| 139 | 3639 | 132424 | 132981 | 558 | sp: CAH_METTE | *Methanosarcina thermophila* | 30.9 | 53.2 | 201 | carbonate dehydratase |
| 140 | 3640 | 134113 | 132971 | 1143 | sp: XYLR_BACSU | *Bacillus subtilis* W23 xylR | 24.1 | 49.3 | 357 | xylose operon repressor protein |
| 141 | 3641 | 135478 | 134207 | 1272 | gp: LLLPK214_12 | *Lactococcus lactis* mef214 | 21.1 | 61.2 | 418 | macrolide efflux protein |
| 142 | 3642 | 136321 | 135518 | 804 | | | | | | |
| 143 | 3643 | 136665 | 136122 | 444 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 144 | 3644 | 136804 | 138744 | 1941 | pir: I39714 | Agrobacterium tumefaciens celA | 24.3 | 51.2 | 420 | cellulose synthase |
| 145 | 3645 | 138791 | 140329 | 1539 | sp: HKR1_YEAST | Saccharomyces cerevisiae YDR420W hkr1 | 25.1 | 51.8 | 593 | hypothetical membrane protein |
| 146 | 3646 | 139861 | 139226 | 636 | | | | | | |
| 147 | 3647 | 140329 | 141789 | 1461 | | | | | | |
| 148 | 3648 | 141796 | 143526 | 1731 | | | | | | |
| 149 | 3649 | 142455 | 143075 | 621 | | | | | | |
| 150 | 3650 | 143575 | 144639 | 1065 | | | | | | |
| 151 | 3651 | 144725 | 145480 | 756 | | | | | | |
| 152 | 3652 | 146396 | 145518 | 879 | sp: RARD_PSEAE | Pseudomonas aeruginosa rarD | 34.7 | 60.7 | 303 | chloramphenicol sensitive protein |
| 153 | 3653 | 146522 | 147238 | 717 | sp: YADS_ECOLI | Escherichia coli K12 yadS | 30.3 | 59.1 | 198 | hypothetical membrane protein |
| 154 | 3654 | 147238 | 147570 | 333 | | | | | | |
| 155 | 3655 | 148122 | 149780 | 1659 | | | | | | |
| 156 | 3656 | 150930 | 149794 | 1137 | sp: ABRB_ECOLI | Escherichia coli K12 abrB | 32.4 | 62.3 | 361 | transport protein |
| 157 | 3657 | 151572 | 152369 | 798 | sp: YFCA_ECOLI | Escherichia coli K12 yfcA | 34.7 | 70.2 | 248 | hypothetical membrane protein |
| 158 | 3658 | 151589 | 150966 | 624 | | | | | | |
| 159 | 3659 | 152410 | 152814 | 405 | | | | | | |
| 160 | 3660 | 155613 | 153226 | 2388 | sp: HRPB_ECOLI | Escherichia coli K12 hrpB | 33.8 | 64.3 | 829 | ATP-dependent helicase |
| 161 | 3661 | 155853 | 156167 | 315 | sp: NODL_RHILV | Rhizobium leguminosarum bv. viciae plasmid pRL1JI nodL | 40.4 | 66.0 | 188 | nodulation protein |
| 162 | 3662 | 156821 | 156147 | 675 | | | | | | |
| 163 | 3663 | 156848 | 157537 | 690 | sp: ALKB_ECOLI | Escherichia coli o373#1 alkB | 34.7 | 60.7 | 219 | DNA repair system specific for alkylated DNA |
| 164 | 3664 | 157614 | 158138 | 525 | sp: 3MG1_ECOLI | Escherichia coli K12 tag | 39.8 | 65.1 | 166 | DNA-3-methyladenine glycosylase |
| 165 | 3665 | 158154 | 158831 | 678 | sp: RHTC_ECOLI | Escherichia coli K12 rhtC | 34.1 | 61.3 | 217 | threonine efflux protein |
| 166 | 3666 | 158869 | 159159 | 291 | sp: YAAA_BACSU | Bacillus subtilis yaaA | 50.9 | 72.7 | 55 | hypothetical protein |
| 167 | 3667 | 159162 | 160013 | 852 | pfl: 2510326B | Streptomyces peucetius dnrV | 31.0 | 52.1 | 284 | doxorubicin biosynthesis enzyme |
| 168 | 3668 | 160029 | 160370 | 342 | gp: SPAC1250_3 | Schizosaccharomyces pombe SPAC1250.04c | 35.6 | 56.7 | 104 | methyltransferase |
| 169 | 3669 | 160431 | 161360 | 930 | | | | | | |
| 170 | 3670 | 161696 | 162352 | 657 | | | | | | |
| 171 | 3671 | 162295 | 161363 | 933 | | | | | | |
| 172 | 3672 | 162463 | 162867 | 405 | gp: AE002420_13 | Neisseria meningitidis MC58 NMB0662 | 41.5 | 76.3 | 118 | ribonuclease |
| 173 | 3673 | 162965 | 163603 | 639 | | | | | | |
| 174 | 3674 | 165717 | 166457 | 741 | | | | | | |
| 175 | 3675 | 165755 | 163689 | 2067 | gp: AF176569_1 | Mus musculus nl1 | 28.5 | 57.2 | 722 | neprilysin-like metallopeptidase 1 |
| 176 | 3676 | 166457 | 167419 | 963 | | | | | | |
| 177 | 3677 | 168595 | 167837 | 759 | sp: FARR_ECOLI | Escherichia coli K12 farR | 29.8 | 65.6 | 238 | transcriptional regulator, GntR family or fatty acyl-responsive regulator |
| 178 | 3678 | 168975 | 169991 | 1017 | pir: T14544 | Beta vulgaris | 28.6 | 63.0 | 332 | fructokinase or carbohydrate kinase |
| 179 | 3679 | 169996 | 170916 | 921 | gp: SC8F11_3 | Streptomyces coelicolor A3(2) SC8F11.03c | 52.7 | 80.7 | 296 | hypothetical protein |
| 180 | 3680 | 170933 | 172444 | 1512 | pfl: 2204281A | Streptomyces coelicolor msdA | 61.0 | 86.1 | 498 | methylmalonic acid semialdehyde dehydrogenase |
| 181 | 3681 | 172468 | 173355 | 888 | sp: IOLB_BACSU | Bacillus subtilis iolB | 33.2 | 58.2 | 268 | myo-inositol catabolism |
| 182 | 3682 | 173548 | 175275 | 1728 | sp: IOLD_BACSU | Bacillus subtilis iolD | 41.0 | 69.8 | 586 | myo-inositol catabolism |
| 183 | 3683 | 175319 | 176272 | 954 | sp: MOCC_RHIME | Rhizobium meliloti mocC | 29.7 | 51.0 | 290 | rhizopine catabolism protein |
| 184 | 3684 | 176308 | 177318 | 1011 | sp: MI2D_BACSU | Bacillus subtilis idh or iolG | 39.1 | 72.2 | 335 | myo-inositol 2-dehydrogenase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 185 | 3685 | 177334 | 178203 | 870 | sp: IOLH_BACSU | *Bacillus subtilis* iolH | 44.6 | 72.1 | 287 | myo-inositol catabolism |
| 186 | 3686 | 178285 | 179658 | 1374 | sp: TCMA_STRGA | *Streptomyces glaucescens* tcmA | 30.9 | 61.5 | 457 | metabolite export pump of tetracenomycin C resistance |
| 187 | 3687 | 179081 | 178461 | 621 | | | | | | |
| 188 | 3688 | 179689 | 180711 | 1023 | sp: YVAA_BACSU | *Bacillus subtilis* yvaA | 31.1 | 65.5 | 354 | oxidoreductase |
| 189 | 3689 | 180842 | 181297 | 456 | | | | | | |
| 190 | 3690 | 181264 | 181647 | 384 | | | | | | |
| 191 | 3691 | 182679 | 181687 | 993 | gp: SRE9798_1 | *Streptomyces reticuli* cebR | 32.0 | 61.9 | 331 | regulatory protein |
| 192 | 3692 | 182819 | 184051 | 1233 | sp: Y4HM_RHISN | *Rhizobium* sp. NGR234 y4hM | 24.4 | 52.5 | 442 | oxidoreductase |
| 193 | 3693 | 184077 | 185087 | 1011 | sp: YFIH_BACSU | *Bacillus subtilis* yfiH | 33.7 | 64.7 | 303 | hypothetical protein |
| 194 | 3694 | 185214 | 185642 | 429 | | | | | | |
| 195 | 3695 | 186508 | 186708 | 201 | sp: CSP_ARTGO | *Streptomyces coelicolor* A3(2) csp | 70.3 | 92.2 | 64 | cold shock protein |
| 196 | 3696 | 186769 | 187302 | 534 | | | | | | |
| 197 | 3697 | 187302 | 187607 | 306 | | | | | | |
| 198 | 3698 | 187687 | 188100 | 414 | prf: 2113413A | *Stellaria longipes* | 30.6 | 58.2 | 134 | caffeoyl-CoA 3-O-methyltransferase |
| 199 | 3699 | 188725 | 188300 | 426 | | | | | | |
| 200 | 3700 | 189736 | 188747 | 990 | sp: CCPA_BACSU | *Bacillus subtilis* ccpA | 28.7 | 62.1 | 338 | glucose-resistance amylase regulator regulator |
| 201 | 3701 | 189920 | 190321 | 402 | | | | | | |
| 202 | 3702 | 190628 | 190389 | 240 | | | | | | |
| 203 | 3703 | 192175 | 190703 | 1473 | sp: XYLT_LACBR | *Lactobacillus brevis* xylT | 36.0 | 70.5 | 458 | D-xylose proton symporter |
| 204 | 3704 | 193248 | 192949 | 300 | | | | | | |
| 205 | 3705 | 193262 | 194464 | 1203 | gp: AF189147_1 | *Corynebacterium glutamicum* ATCC 13032 tnp | 100.0 | 100.0 | 401 | transposase (ISCg2) |
| 206 | 3706 | 195038 | 194604 | 435 | sp: FIXL_RHIME | *Rhizobium meliloti* fixL | 27.6 | 60.7 | 145 | signal-transducing histidine kinase |
| 207 | 3707 | 195240 | 199769 | 4530 | gp: AB024708_1 | *Corynebacterium glutamicum* gltB | 99.9 | 100.0 | 1510 | glutamine 2-oxoglutarate aminotransferase large subunit |
| 208 | 3708 | 199772 | 201289 | 1518 | gp: AB024708_2 | *Corynebacterium glutamicum* gltD | 99.4 | 99.8 | 506 | glutamine 2-oxoglutarate aminotransferase small subunit |
| 209 | 3709 | 201580 | 201341 | 240 | | | | | | |
| 210 | 3710 | 203244 | 201760 | 1485 | pir: C70793 | *Mycobacterium tuberculosis* H37Rv Rv3698 | 44.6 | 72.8 | 496 | hypothetical protein |
| 211 | 3711 | 205588 | 205956 | 369 | | | | | | |
| 212 | 3712 | 206068 | 206385 | 318 | prf: 2224383C | *Mycobacterium avium* embB | 39.8 | 70.6 | 1122 | arabinosyl transferase |
| 213 | 3713 | 207011 | 203541 | 3471 | pir: D70697 | *Mycobacterium tuberculosis* H37Rv Rv3792 | 35.0 | 66.1 | 651 | hypothetical membrane protein |
| 214 | 3714 | 208989 | 207007 | 1983 | | | | | | |
| 215 | 3715 | 209968 | 209210 | 759 | prf: 2504279B | *Pseudomonas* sp. phbB | 31.4 | 56.5 | 223 | acetoacetyl CoA reductase |
| 216 | 3716 | 211455 | 209992 | 1464 | pir: B70697 | *Mycobacterium tuberculosis* H37Rv Rv3790 | 66.0 | 85.1 | 464 | oxidoreductase |
| 217 | 3717 | 211768 | 211535 | 234 | | | | | | |
| 218 | 3718 | 211777 | 212283 | 507 | | | | | | |
| 219 | 3719 | 212283 | 212735 | 453 | | | | | | |
| 220 | 3720 | 212656 | 213657 | 1002 | gp: LMA243459_1 | *Leishmania major* ppg1 | 24.3 | 57.4 | 350 | proteophosphoglycan |
| 221 | 3721 | 213712 | 214107 | 396 | sp: Y0GN_MYCTU | *Mycobacterium tuberculosis* H37Rv Rv3789 | 60.5 | 83.9 | 124 | hypothetical protein |
| 222 | 3722 | 214121 | 214522 | 402 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 223 | 3723 | 214527 | 215159 | 633 | pir: H70666 | *Mycobacterium tuberculosis* H37Rv Rv1864c | 43.2 | 73.8 | 206 | hypothetical protein |
| 224 | 3724 | 216100 | 215162 | 939 | pir: B70696 | *Mycobacterium tuberculosis* H37Rv Rv3782 rfbE | 63.6 | 79.1 | 302 | rhamnosyl transferase |
| 225 | 3725 | 216264 | 216605 | 342 | gp: AB016260_100 | *Agrobacterium tumefaciens* plasmid pTi-SAKURA tiorf100 | 31.3 | 55.1 | 214 | hypothetical protein |
| 226 | 3726 | 216712 | 216116 | 597 | | | | | | |
| 227 | 3727 | 217929 | 217141 | 789 | sp: RFBE_YEREN | *Yersinia enterocolitica* rfbE | 47.0 | 78.4 | 236 | O-antigen export system ATP-binding protein |
| 228 | 3728 | 218746 | 217943 | 804 | sp: RFBD_YEREN | *Yersinia enterocolitica* rfbD | 31.3 | 75.6 | 262 | O-antigen export system permease protein |
| 229 | 3729 | 218979 | 220151 | 1173 | pir: F70695 | *Mycobacterium tuberculosis* H37Rv Rv3778c | 36.5 | 63.0 | 416 | hypothetical protein |
| 230 | 3730 | 221107 | 220154 | 954 | gp: AF010309_1 | *Homo sapiens* pig3 | 41.1 | 71.5 | 302 | NADPH quinone oxidoreductase |
| 231 | 3731 | 221712 | 221131 | 582 | | | | | | |
| 232 | 3732 | 221911 | 222207 | 297 | PIR: A70606 | *Mycobacterium tuberculosis* H37Rv Rv3571 | 35.0 | 51.0 | 78 | probable electron transfer protein |
| 233 | 3733 | 223685 | 222210 | 1476 | sp: ALST_BACSU | *Bacillus subtilis* alsT | 46.7 | 75.8 | 475 | amino acid carrier protein |
| 234 | 3734 | 224336 | 225244 | 909 | | | | | | |
| 235 | 3735 | 226324 | 225242 | 1083 | gp: SYPCCMOEB_1 | *Synechococcus* sp. PCC 7942 moeB | 43.8 | 70.1 | 368 | molybdopterin biosynthesis protein moeB (sulfurylase) |
| 236 | 3736 | 226767 | 226312 | 456 | prf: 2403296D | *Arthrobacter nicotinovorans* moaE | 44.7 | 75.3 | 150 | molybdopterin synthase, large subunit |
| 237 | 3737 | 227230 | 226760 | 471 | sp: MOCB_SYNP7 | *Synechococcus* sp. PCC 7942 moaCB | 33.5 | 63.3 | 158 | molybdenum cofactor biosynthesis protein CB |
| 238 | 3738 | 227685 | 227218 | 468 | prf: 2403296C | *Arthrobacter nicotinovorans* moaC | 61.7 | 84.4 | 154 | co-factor synthesis protein |
| 239 | 3739 | 228887 | 227703 | 1185 | gp: ANY10817_2 | *Arthrobacter nicotinovorans* moeA | 34.5 | 58.6 | 377 | molybdopterin co-factor synthesis protein |
| 240 | 3740 | 229613 | 228891 | 723 | prf: 2403296F | *Arthrobacter nicotinovorans* modB | 44.1 | 70.5 | 227 | hypothetical membrane protein |
| 241 | 3741 | 230514 | 229711 | 804 | prf: 2403296E | *Arthrobacter nicotinovorans* modA | 34.0 | 68.0 | 256 | molybdate-binding periplasmic protein |
| 242 | 3742 | 230608 | 230928 | 321 | pir: D70816 | *Mycobacterium tuberculosis* H37Rv moaD2 | 37.5 | 70.8 | 96 | molybdopterin converting factor subunit 1 |
| 243 | 3743 | 231842 | 230931 | 912 | prf: 2518354A | *Thermococcus litoralis* malK | 34.3 | 60.8 | 365 | maltose transport protein |
| 244 | 3744 | 232267 | 231848 | 420 | sp: YPT3_STRCO | *Streptomyces coelicolor* A3(2) ORF3 | 36.4 | 76.9 | 121 | hypothetical membrane protein |
| 245 | 3745 | 233282 | 232260 | 1023 | sp: HIS8_ZYMMO | *Zymomonas mobilis* hisC | 37.3 | 65.8 | 330 | histidinol-phosphate aminotransferase |
| 246 | 3746 | 233913 | 234818 | 906 | | | | | | |
| 247 | 3747 | 235203 | 234910 | 294 | | | | | | |
| 248 | 3748 | 235290 | 235409 | 120 | | | | | | |
| 249 | 3749 | 236212 | 235451 | 762 | gp: BAU81286_1 | *Brucella abortus* oxyR | 29.4 | 57.1 | 252 | transcription factor |
| 250 | 3750 | 236326 | 237342 | 1017 | sp: ADH2_BACST | *Bacillus stearothermophilus* DSM 2334 adh | 34.0 | 66.0 | 335 | alcohol dehydrogenase |
| 251 | 3751 | 237345 | 238145 | 801 | sp: PUO_MICRU | *Micrococcus rubens* puo | 21.5 | 38.1 | 451 | putrescine oxidase |
| 252 | 3752 | 238176 | 239525 | 1350 | prf: 2305239A | *Borrelia burgdorferi* mgtE | 30.9 | 68.5 | 444 | magnesium ion transporter |
| 253 | 3753 | 239772 | 239945 | 174 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 254 | 3754 | 239986 | 241515 | 1530 | prf: 2320140A | *Xenopus laevis* | 33.2 | 59.6 | 567 | Na/dicarboxylate cotransporter |
| 255 | 3755 | 242902 | 241883 | 1020 | pir: C70800 | *Mycobacterium tuberculosis* H37Rv tyrA | 46.1 | 69.1 | 317 | oxidoreductase |
| 256 | 3756 | 242910 | 243431 | 522 | pir: B70800 | *Mycobacterium tuberculosis* H37Rv Rv3753c | 48.8 | 73.8 | 160 | hypothetical protein |
| 257 | 3757 | 243494 | 243910 | 417 | gp: RHBNFXP_1 | *Bradyrhizobium japonicum* | 45.1 | 70.1 | 144 | nitrogen fixation protein |
| 258 | 3758 | 244015 | 244215 | 201 | | | | | | |
| 259 | 3759 | 244466 | 244816 | 351 | | | | | | |
| 260 | 3760 | 244902 | 247304 | 2403 | sp: YV34_MYCTU | *Mycobacterium tuberculosis* H37Rv Rv0507 mmpL2 | 20.7 | 45.7 | 997 | membrane transport protein |
| 261 | 3761 | 247310 | 248572 | 1263 | sp: TGT_ZYMMO | *Zymomonas mobilis* | 41.3 | 68.0 | 400 | queuine tRNA-ribosyltransferase |
| 262 | 3762 | 249294 | 248557 | 738 | sp: YPDP_BACSU | *Bacillus subtilis* ypdP | 28.1 | 62.1 | 203 | hypothetical membrane protein |
| 263 | 3763 | 249428 | 250507 | 1080 | | | | | | |
| 264 | 3764 | 250369 | 249722 | 648 | | | | | | |
| 265 | 3765 | 250503 | 251939 | 1437 | pir: S65588 | *Streptomyces glaucescens* strW | 24.3 | 49.6 | 526 | ABC transporter |
| 266 | 3766 | 251952 | 252830 | 879 | sp: SYE_BACSU | *Bacillus subtilis* gltX | 34.8 | 63.3 | 316 | glutamyl-tRNA synthetase |
| 267 | 3767 | 253819 | 252830 | 990 | | | | | | |
| 268 | 3768 | 255438 | 254329 | 1110 | gp: PSESTBCBAD_1 | *Pseudomonas syringae* tnpA | 34.2 | 55.0 | 360 | transposase |
| 269 | 3769 | 255794 | 255492 | 303 | | | | | | |
| 270 | 3770 | 256067 | 256204 | 138 | | | | | | |
| 271 | 3771 | 256599 | 257894 | 1296 | gsp: W69554 | *Brevibacterium lactofermentum* aspC | 98.6 | 100.0 | 432 | aspartate transaminase |
| 272 | 3772 | 257900 | 258529 | 630 | | | | | | |
| 273 | 3773 | 258551 | 260875 | 2325 | gp: AF025391_1 | *Thermus thermophilus* dnaX | 31.6 | 53.1 | 642 | DNA polymerase III holoenzyme tau subunit |
| 274 | 3774 | 259312 | 258596 | 717 | | | | | | |
| 275 | 3775 | 260987 | 261295 | 309 | sp: YAAK_BACSU | *Bacillus subtilis* yaaK | 41.6 | 74.3 | 101 | hypothetical protein |
| 276 | 3776 | 261402 | 262055 | 654 | sp: RECR_BACSU | *Bacillus subtilis* recR | 42.5 | 72.4 | 214 | recombination protein |
| 277 | 3777 | 263295 | 262546 | 750 | prf: 2503462B | *Heliobacillus mobilis* cobQ | 38.3 | 61.7 | 248 | cobyric acid synthase |
| 278 | 3778 | 264566 | 263298 | 1269 | prf: 2503462C | *Heliobacillus mobilis* murC | 31.3 | 60.6 | 444 | UDP-N-acetylmuramyl tripeptide synthetase |
| 279 | 3779 | 265678 | 264599 | 1080 | pir: H70794 | *Mycobacterium tuberculosis* H37Rv dnaQ | 25.7 | 55.2 | 346 | DNA polymerase III epsilon chain |
| 280 | 3780 | 269124 | 268258 | 867 | sp: YLEU_CORGL | *Corynebacterium glutamicum* (*Brevibacterium flavum*) ATCC 13032 orfX | 100.0 | 100.0 | 270 | hypothetical membrane protein |
| 281 | 3781 | 269371 | 270633 | 1263 | sp: AKAB_CORGL | *Corynebacterium glutamicum* lysC-alpha | 99.5 | 99.8 | 421 | aspartate kinase alpha chain |
| 282 | 3782 | 270576 | 269524 | 1053 | | | | | | |
| 283 | 3783 | 271761 | 273194 | 1434 | | | | | | |
| 284 | 3784 | 274120 | 273542 | 579 | prf: 2312309A | *Mycobacterium smegmatis* sigE | 31.2 | 63.5 | 189 | extracytoplasmic function alternative sigma factor |
| 285 | 3785 | 274366 | 275871 | 1506 | sp: CATV_BACSU | *Bacillus subtilis* katA | 52.9 | 76.4 | 492 | vegetative catalase |
| 286 | 3786 | 275891 | 276232 | 342 | | | | | | |
| 287 | 3787 | 276247 | 275957 | 291 | | | | | | |
| 288 | 3788 | 276763 | 276302 | 462 | sp: LRP_KLEPN | *Klebsiella pneumoniae* lrp | 37.1 | 72.0 | 143 | leucine-responsive regulatory protein |
| 289 | 3789 | 276829 | 277581 | 753 | sp: AZLC_BACSU | *Bacillus subtilis* 1A1 aziC | 30.5 | 68.0 | 203 | branched-chain amino acid transport |
| 290 | 3790 | 277581 | 277904 | 324 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 291 | 3791 | 278301 | 277987 | 315 | gp: AF178758_1 | *Sinorhizobium* sp. As4 arsR | 34.4 | 68.9 | 90 | metalloregulatory protein |
| 292 | 3792 | 278732 | 278388 | 345 | | | 52.2 | 84.2 | 341 | arsenic oxyanion-translocation pump membrane subunit |
| 293 | 3793 | 278814 | 279893 | 1080 | gp: AF178758_2 | *Sinorhizobium* sp. As4 arsB | | | | |
| 294 | 3794 | 279893 | 280279 | 387 | sp: ARSC_STAXY | *Staphylococcus xylosus* arsC | 31.1 | 68.9 | 119 | arsenate reductase |
| 295 | 3795 | 280666 | 280349 | 318 | | | | | | |
| 296 | 3796 | 280939 | 280670 | 270 | | | | | | |
| 297 | 3797 | 281401 | 280949 | 453 | | | | | | |
| 298 | 3798 | 282933 | 281404 | 1530 | gp: AF097740_4 | *Bacillus firmus* OF4 mrpD | 32.4 | 70.4 | 503 | Na+/H+ antiporter or multiple resistance and pH regulation related protein D |
| 299 | 3799 | 283317 | 282937 | 381 | | | 37.0 | 70.6 | 119 | Na+/H+ antiporter |
| 300 | 3800 | 286202 | 283317 | 2886 | gp: AF097740_1 | *Bacillus firmus* OF4 mrpA | 34.1 | 64.3 | 824 | Na+/H+ antiporter or multiple resistance and pH regulation related protein A |
| 301 | 3801 | 286373 | 287857 | 1485 | | | | | | |
| 302 | 3802 | 287661 | 287059 | 603 | | | | | | |
| 303 | 3803 | 288829 | 287966 | 864 | | | | | | |
| 304 | 3804 | 289796 | 289131 | 666 | sp: CZCR_ALCEU | *Alcaligenes eutrophus* CH34 czcR | 38.6 | 70.4 | 223 | transcriptional activator |
| 305 | 3805 | 291243 | 289777 | 1467 | prf: 2214304B | *Mycobacterium tuberculosis* mtrB | 26.7 | 56.8 | 521 | two-component system sensor histidine kinase |
| 306 | 3806 | 291815 | 292417 | 603 | sp: APL_LACLA | *Lactococcus lactis* MG1363 apl | 28.3 | 60.0 | 180 | alkaline phosphatase |
| 307 | 3807 | 291833 | 291273 | 561 | | | | | | |
| 308 | 3808 | 293511 | 292597 | 915 | pir: B69865 | *Bacillus subtilis* ykuE | 26.1 | 54.7 | 307 | phosphoesterase |
| 309 | 3809 | 293539 | 293991 | 453 | sp: YQEY_BACSU | *Bacillus subtilis* yqeY | 37.6 | 71.8 | 149 | hypothetical protein |
| 310 | 3810 | 296388 | 294004 | 2385 | prf: 2209359A | *Mycobacterium leprae* pon1 | 48.3 | 77.1 | 782 | class A penicillin-binding protein(PBP1) |
| 311 | 3811 | 297064 | 297402 | 339 | pir: S20912 | *Streptomyces coelicolor* A3(2) whiB | 40.9 | 63.4 | 71 | regulatory protein |
| 312 | 3812 | 297431 | 297622 | 192 | | | | | | |
| 313 | 3813 | 297631 | 297783 | 153 | gp: SCH17_10 | *Streptomyces coelicolor* A3(2) SCH17.10c | 84.0 | 96.0 | 50 | hypothetical protein |
| 314 | 3814 | 297792 | 298250 | 459 | gp: G70790 | *Mycobacterium tuberculosis* H37Rv Rv3678c | 65.1 | 89.9 | 149 | transcriptional regulator |
| 315 | 3815 | 299684 | 298332 | 1353 | sp: SHIA_ECOLI | *Escherichia coli* K12 shiA | 37.3 | 68.9 | 440 | shikimate transport protein |
| 316 | 3816 | 300087 | 300695 | 609 | | | | | | |
| 317 | 3817 | 301261 | 299726 | 1536 | sp: LCFA_BACSU | *Bacillus subtilis* lcfA | 31.1 | 59.9 | 534 | long-chain-fatty-acid—CoA ligase |
| 318 | 3818 | 302036 | 301512 | 525 | gp: SCJ4_28 | *Streptomyces coelicolor* A3(2) SCJ4.28c | 33.9 | 65.4 | 127 | transcriptional regulator |
| 319 | 3819 | 302167 | 303099 | 933 | sp: FABG_BACSU | *Bacillus subtilis* fabG | 41.0 | 72.5 | 251 | 3-oxoacyl-(acyl-carrier-protein) reductase |
| 320 | 3820 | 303133 | 304074 | 942 | sp: FLUG_EMENI | *Emericella nidulans* fluG | 27.2 | 52.0 | 254 | glutamine synthetase |
| 321 | 3821 | 304070 | 305263 | 1194 | prf: 2512386A | *Arabidopsis thaliana* atg6 | 38.8 | 66.5 | 394 | short-chain acyl CoA oxidase |
| 322 | 3822 | 305288 | 305758 | 471 | sp: NODN_RHILV | *Rhizobium leguminosarum* nodN | 45.8 | 72.6 | 153 | nodulation protein |
| 323 | 3823 | 305858 | 306700 | 843 | pir: F70790 | *Mycobacterium tuberculosis* H37Rv Rv3677c | 41.2 | 72.4 | 272 | hydrolase |
| 324 | 3824 | 306367 | 305195 | 1173 | | | | | | |
| 325 | 3825 | 306800 | 307504 | 705 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 326 | 3826 | 307462 | 306782 | 681 | prf: 2323349A | Vibrio cholerae crp | 30.9 | 65.7 | 207 | cAMP receptor protein |
| 327 | 3827 | 307918 | 307727 | 192 | | | | | | |
| 328 | 3828 | 307955 | 308734 | 780 | sp: UVEN_MICLU | Micrococcus luteus pdg | 57.5 | 77.1 | 240 | ultraviolet N-glycosylase/AP lyase |
| 329 | 3829 | 308745 | 309302 | 558 | pir: B70790 | Mycobacterium tuberculosis H37Rv Rv3673c | 34.6 | 58.3 | 211 | cytochrome c biogenesis protein |
| 330 | 3830 | 309370 | 310038 | 669 | sp: YEAB_ECOLI | Escherichia coli K12 yeaB | 30.7 | 56.3 | 192 | hypothetical protein |
| 331 | 3831 | 310135 | 311325 | 1191 | pir: H70789 | Mycobacterium tuberculosis H37Rv Rv3671c | 38.6 | 71.0 | 396 | serine proteinase |
| 332 | 3832 | 312891 | 311899 | 993 | prf: 2411250A | Corynebacterium sp. C12 cEH | 29.6 | 52.1 | 280 | epoxide hydrolase |
| 333 | 3833 | 313457 | 312909 | 549 | pir: F70789 | Mycobacterium tuberculosis H37Rv Rv3669 | 46.8 | 77.6 | 156 | hypothetical membrane protein |
| 334 | 3834 | 314590 | 313625 | 966 | | Mycobacterium leprae MTCY20G9.32C, serB | 29.6 | 65.5 | 287 | phosphoserine phosphatase |
| 335 | 3835 | 314980 | 316002 | 1023 | pir: E70788 | Mycobacterium tuberculosis H37Rv Rv3660c | 35.0 | 60.2 | 349 | hypothetical protein |
| 336 | 3836 | 316110 | 317132 | 1023 | pir: C44020 | Escherichia coli trbB | 32.9 | 66.5 | 319 | conjugal transfer region protein |
| 337 | 3837 | 316964 | 316350 | 615 | | | | | | |
| 338 | 3838 | 317078 | 317893 | 816 | pir: C70788 | Mycobacterium tuberculosis H37Rv Rv3658c | 30.5 | 63.7 | 262 | hypothetical membrane protein |
| 339 | 3839 | 317920 | 318465 | 546 | pir: B70788 | Mycobacterium tuberculosis H37Rv Rv3657c | 33.8 | 64.2 | 201 | hypothetical protein |
| 340 | 3840 | 318492 | 318689 | 198 | pir: A70788 | Mycobacterium tuberculosis H37Rv Rv3656c | 47.5 | 84.8 | 59 | hypothetical protein |
| 341 | 3841 | 318696 | 319013 | 318 | | | | | | |
| 342 | 3842 | 318958 | 318545 | 414 | | | | | | |
| 343 | 3843 | 318991 | 319335 | 345 | | | | | | |
| 344 | 3844 | 321690 | 319336 | 2355 | sp: YPRA_BACSU | Bacillus subtilis yprA | 33.8 | 66.1 | 764 | ATP-dependent RNA helicase |
| 345 | 3845 | 322007 | 322207 | 201 | sp: CSP_ARTGO | Arthrobacter globiformis SI55 csp | 68.7 | 88.1 | 67 | cold shock protein |
| 346 | 3846 | 322216 | 325897 | 2988 | pir: G70563 | Mycobacterium tuberculosis H37Rv Rv3646c topA | 61.7 | 81.6 | 977 | DNA topoisomerase I |
| 347 | 3847 | 322910 | | | | | | | | |
| 348 | 3848 | 325904 | 326614 | 711 | sp: CYAB_STIAU | Stigmatella aurantiaca B17R20 cyaB | 32.7 | 62.4 | 263 | adenylate cyclase |
| 349 | 3849 | 327735 | 326695 | 1041 | | | | | | |
| 350 | 3850 | 328283 | 329539 | 1257 | sp: DP3X_BACSU | Bacillus subtilis dnaX | 25.3 | 52.7 | 423 | DNA polymerase III subunit tau/gamma |
| 351 | 3851 | 329748 | 329909 | 162 | | | | | | |
| 352 | 3852 | 329933 | 330376 | 444 | gp: AE002103_3 | Ureaplasma urealyticum uu033 | 32.6 | 59.0 | 144 | hypothetical protein |
| 353 | 3853 | 330973 | 331533 | 561 | gp: AE001882_8 | Deinococcus radiodurans DR0202 | 39.0 | 63.4 | 172 | hypothetical protein |
| 354 | 3854 | 331552 | 332433 | 882 | sp: RLUC_ECOLI | Escherichia coli K12 rluC | 43.6 | 65.0 | 314 | ribosomal large subunit pseudouridine synthase C |
| 355 | 3855 | 332919 | 334562 | 1644 | sp: BGLX_ERWCH | Erwinia chrysanthemi D1 bgxA | 34.8 | 60.2 | 558 | beta-glucosidase/xylosidase |
| 356 | 3856 | 332965 | 334953 | 1989 | gp: AF090429_2 | Azospirillum irakense salB | 38.6 | 61.4 | 101 | beta-glucosidase |
| 357 | 3857 | 335009 | 336112 | 1104 | sp: FADH_AMYME | Amycolatopsis methanolica | 66.6 | 86.5 | 362 | NAD/mycothiol-dependent formaldehyde dehydrogenase |
| 358 | 3858 | 335805 | 335185 | 621 | | | | | | |
| 359 | 3859 | 336212 | 336748 | 537 | sp: YTH5_RHOSN | Rhodococcus erythropolis orf5 | 32.5 | 47.5 | 160 | metallo-beta-lactamase superfamily |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 360 | 3860 | 336781 | 337449 | 669 | sp: FABG_ECOLI | Escherichia coli K12 fabG | 25.9 | 55.8 | 251 | 3-oxoacyl-(acyl-carrier-protein) reductase |
| 361 | 3861 | 337539 | 338768 | 1230 | gp: AF148322_1 | Streptomyces viridifaciens vlmF | 26.3 | 56.4 | 415 | valanimycin resistant protein |
| 362 | 3862 | 338793 | 339725 | 933 | prf: 2512357B | Actinoplanes sp. acbB | 33.8 | 66.3 | 320 | dTDP-glucose 4,6-dehydratase |
| 363 | 3863 | 340569 | 340195 | 375 | pir: A70562 | Mycobacterium tuberculosis H37Rv Rv3632 | 59.3 | 88.9 | 108 | hypothetical protein |
| 364 | 3864 | 341327 | 340569 | 759 | sp: YC22_METJA | Methanococcus jannaschii JAL-1 MJ1222 | 33.9 | 66.5 | 230 | dolichol phosphate mannose synthase |
| 365 | 3865 | 341347 | 342375 | 1029 | | | | | | |
| 366 | 3866 | 342417 | 343451 | 1035 | sp: YEFI_ECOLI | Escherichia coli K12 yefI | 25.8 | 57.3 | 260 | nucleotide sugar synthetase |
| 367 | 3867 | 343636 | 345717 | 2082 | sp: USHA_SALTY | Salmonella typhimurium ushA | 26.1 | 54.4 | 586 | UDP-sugar hydrolase |
| 368 | 3868 | 345975 | 345814 | 162 | | | | | | |
| 369 | 3869 | 346460 | 346110 | 351 | | | | | | |
| 370 | 3870 | 348019 | 346961 | 1059 | sp: ADH_MYCTU | Mycobacterium tuberculosis H37Rv adhC | 52.2 | 74.9 | 343 | NADP-dependent alcohol dehydrogenase |
| 371 | 3871 | 348952 | 348098 | 855 | sp: RFBA_SALAN | Salmonella anatum M32 rfbA | 62.8 | 84.9 | 285 | glucose-1-phosphate thymidylyltransferase |
| 372 | 3872 | 350310 | 348952 | 1359 | gp: D78182_5 | Streptococcus mutans rmlC | 49.5 | 74.0 | 192 | dTDP-4-keto-L-rhamnose reductase |
| 373 | 3873 | 351443 | 350313 | 1131 | sp: RMLB_STRMU | Streptococcus mutans XC rmlB | 61.8 | 83.4 | 343 | dTDP-glucose 4,6-dehydratase |
| 374 | 3874 | 351948 | 351370 | 579 | sp: NOX_THETH | Thermus aquaticus HB8 nox | 35.4 | 61.2 | 206 | NADH dehydrogenase |
| 375 | 3875 | 352693 | 353637 | 945 | prf: 2510361A | Staphylococcus aureus sirA | 33.2 | 66.5 | 325 | Fe-regulated protein |
| 376 | 3876 | 354387 | 353749 | 639 | | | | | | |
| 377 | 3877 | 355906 | 354599 | 1308 | sp: Y17M_MYCTU | Mycobacterium tuberculosis H37Rv Rv3630 | 37.4 | 68.3 | 423 | hypothetical membrane protein |
| 378 | 3878 | 357228 | 355849 | 1380 | gp: SC5F2A_19 | Streptomyces coelicolor SC5F2A.19c | 34.1 | 62.5 | 461 | metallopeptidase |
| 379 | 3879 | 359354 | 357237 | 2118 | prf: 2502226A | Sphingomonas capsulata | 28.4 | 56.4 | 708 | prolyl endopeptidase |
| 380 | 3880 | 360334 | 359762 | 573 | | | | | | |
| 381 | 3881 | 361905 | 360814 | 1092 | gp: SCF43_2 | Streptomyces coelicolor A3(2) | 26.0 | 46.0 | 258 | hypothetical membrane protein |
| 382 | 3882 | 363151 | 362057 | 1095 | gsp: W56155 | Corynebacterium ammoniagenes ATCC 6872 | 50.7 | 76.6 | 363 | cell surface layer protein |
| 383 | 3883 | 363824 | 365257 | 1434 | prf: 2404346B | Acinetobacter johnsonii ptk | 28.5 | 57.2 | 453 | autophosphorylating protein Tyr kinase |
| 384 | 3884 | 365250 | 365852 | 603 | prf: 2404346A | Acinetobacter johnsonii ptp | 39.2 | 68.6 | 102 | protein phosphatase |
| 385 | 3885 | 365855 | 366838 | 984 | | | | | | |
| 386 | 3886 | 366832 | 368643 | 1812 | sp: CAPD_STAAU | Staphylococcus aureus M capD | 33.0 | 65.7 | 613 | capsular polysaccharide biosynthesis |
| 387 | 3887 | 368642 | 367701 | 942 | PRF: 2109288X | Vibrio cholerae | 41.0 | 51.0 | 90 | ORF 3 |
| 388 | 3888 | 368647 | 369801 | 1155 | prf: 2423410L | Campylobacter jejuni wlaK | 37.1 | 68.3 | 394 | lipopolysaccharide biosynthesis/ aminotransferase |
| 389 | 3889 | 369794 | 370405 | 612 | gp: AF014804_1 | Neisseria meningitidis pglB | 54.6 | 75.0 | 196 | pilin glycosylation protein |
| 390 | 3890 | 370613 | 371773 | 1161 | sp: CAPM_STAAU | Staphylococcus aureus M capM | 33.4 | 69.2 | 380 | capsular polysaccharide biosynthesis |
| 391 | 3891 | 371929 | 373419 | 1491 | pir: S67859 | Xanthomonas campestris gumJ | 34.3 | 69.8 | 504 | lipopolysaccharide biosynthesis/ export protein |
| 392 | 3892 | 373500 | 374813 | 1314 | sp: MURA_ENTCL | Enterobacter cloacae murA | 31.4 | 64.6 | 427 | UDP-N-acetylglucosamine 1-carboxyvinyltransferase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 393 | 3893 | 374833 | 375837 | 1005 | sp: MURB_BACSU | Bacillus subtilis murB | 34.8 | 68.5 | 273 | UDP-N-acetylenolpyruvoylglucosamine reductase |
| 394 | 3894 | 375842 | 376876 | 1035 | gp: VCLPSS_9 | Vibrio cholerae ORF39 × 2 | 32.0 | 57.3 | 356 | sugar transferase |
| 395 | 3895 | 377683 | 377832 | 150 | prf: 2211295A | Corynebacterium glutamicum | 60.4 | 79.3 | 53 | transposase |
| 396 | 3896 | 378093 | 378227 | 135 | | | | | | |
| 397 | 3897 | 378185 | 378511 | 327 | pir: S43613 | Corynebacterium glutamicum ATCC 31831 | 75.7 | 94.3 | 70 | transposase (insertion sequence IS31831) |
| 398 | 3898 | 378562 | 378287 | 276 | | | | | | |
| 399 | 3899 | 379837 | 378668 | 1170 | pir: G70539 | Mycobacterium tuberculosis H37Rv Rv1565c | 28.0 | 57.4 | 404 | hypothetical protein |
| 400 | 3900 | 380842 | 379850 | 993 | gsp: W37352 | Pseudomonas aeruginosa PAO1 psbC | 34.5 | 60.2 | 354 | acetyltransferase |
| 401 | 3901 | 381265 | 381495 | 231 | PIR: S60890 | Corynebacterium glutamicum | 44.0 | 53.0 | 65 | hypothetical protein B |
| 402 | 3902 | 381948 | 383108 | 1161 | sp: UDG8_ECOLI | Escherichia coli ugd | 63.7 | 89.7 | 388 | UDP-glucose 6-dehydrogenase |
| 403 | 3903 | 383768 | 383496 | 273 | | | | | | |
| 404 | 3904 | 385190 | 383982 | 1209 | | | | | | |
| 405 | 3905 | 386195 | 385374 | 822 | gp: AF172324_3 | Escherichia coli wbnA | 32.1 | 65.0 | 243 | glycosyl transferase |
| 406 | 3906 | 386556 | 387200 | 645 | gp: AB008676_13 | Escherichia coli 0157 wbhH | 33.0 | 62.0 | 221 | acetyltransferase |
| 407 | 3907 | 387657 | 387463 | 195 | | | | | | |
| 408 | 3908 | 387692 | 389098 | 1407 | gp: CGLPD_1 | Corynebacterium glutamicum ATCC 13032 lpd | 99.6 | 100.0 | 469 | dihydrolipoamide dehydrogenase |
| 409 | 3909 | 389248 | 390168 | 921 | pir: JC4985 | Xanthomonas campestris | 41.7 | 68.1 | 295 | UTP—glucose-1-phosphate uridylyltransferase |
| 410 | 3910 | 390233 | 390730 | 498 | gsp: PAU49666_2 | Pseudomonas aeruginosa PAO1 orfX | 43.8 | 71.9 | 153 | regulatory protein |
| 411 | 3911 | 392208 | 390787 | 1422 | pir: E70828 | Mycobacterium tuberculosis H37Rv Rv0465c | 57.0 | 81.3 | 477 | transcriptional regulator |
| 412 | 3912 | 392705 | 393475 | 771 | gp: SCM10_12 | Streptomyces coelicolor A3(2) SCM10.12c | 34.8 | 67.4 | 230 | cytochrome b subunit |
| 413 | 3913 | 393639 | 395513 | 1875 | pir: A27763 | Bacillus subtilis sdhA | 32.4 | 61.2 | 608 | succinate dehydrogenase flavoprotein |
| 414 | 3914 | 395426 | 396262 | 837 | gp: BMSDHCAB_4 | Paenibacillus macerans sdhB | 27.5 | 56.2 | 258 | succinate dehydrogenase subunit B |
| 415 | 3915 | 396315 | 396650 | 336 | | | | | | |
| 416 | 3916 | 396672 | 396932 | 261 | | | | | | |
| 417 | 3917 | 397040 | 396411 | 630 | | | | | | |
| 418 | 3918 | 397730 | 397825 | 96 | | | | | | |
| 419 | 3919 | 397884 | 398222 | 339 | | | | | | |
| 420 | 3920 | 398206 | 397232 | 975 | gp: SCC78_5 | Streptomyces coelicolor SCC78.05 | 26.3 | 49.8 | 259 | hypothetical protein |
| 421 | 3921 | 398329 | 399579 | 1251 | sp: YJIN_ECOLI | Escherichia coli K12 yjiN | 32.7 | 64.3 | 431 | hypothetical protein |
| 422 | 3922 | 399598 | 400017 | 420 | | | | | | |
| 423 | 3923 | 400039 | 400341 | 303 | | | | | | |
| 424 | 3924 | 400473 | 401150 | 678 | sp: TCMR_STRGA | Streptomyces glaucescens GLA.0 tcmR | 26.4 | 53.8 | 197 | tetracenomycin C transcription repressor |
| 425 | 3925 | 401050 | 401253 | 204 | | | | | | |
| 426 | 3926 | 401150 | 402796 | 1647 | gp: AF164961_8 | Streptomyces fradiae T#2717 urdJ | 36.1 | 74.6 | 499 | transporter |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 427 | 3927 | 402799 | 404430 | 1632 | gp: AF164961_8 | Streptomyces fradiae T#2717 urdJ | 39.6 | 74.6 | 508 | transporter |
| 428 | 3928 | 405419 | 404508 | 912 | sp: PURU_CORSP | Corynebacterium sp. P-1 purU | 40.9 | 72.7 | 286 | formyltetrahydrofolate deformylase |
| 429 | 3929 | 405480 | 406145 | 666 | sp: DEOC_BACSU | Bacillus subtilis deoC | 38.5 | 74.0 | 208 | deoxyribose-phosphate aldolase |
| 430 | 3930 | 406310 | 406161 | 150 | | | | | | |
| 431 | 3931 | 406417 | 405521 | 897 | | | | | | |
| 432 | 3932 | 406550 | 407416 | 867 | prf: 2413441K | Mycobacterium avium GIR10 mav346 | 26.8 | 53.6 | 280 | hypothetical protein |
| 433 | 3933 | 407708 | 407409 | 300 | pir: A70907 | Mycobacterium tuberculosis H37Rv Rv0190 | 58.7 | 85.9 | 92 | hypothetical protein |
| 434 | 3934 | 408546 | 409145 | 600 | | | | | | |
| 435 | 3935 | 409975 | 407711 | 2265 | sp: CTPB_MYCLE | Mycobacterium leprae ctpB | 45.7 | 75.3 | 748 | cation-transporting P-type ATPase B |
| 436 | 3936 | 410476 | 410027 | 450 | | | | | | |
| 437 | 3937 | 410683 | 412545 | 1863 | sp: AMYH_YEAST | Saccharomyces cerevisiae S288C YIR019C sta1 | 27.3 | 56.1 | 626 | glucan 1,4-alpha-glucosidase |
| 438 | 3938 | 412557 | 413633 | 1077 | gp: AF109162_1 | Corynebacterium diphtheriae hmuT | 57.2 | 83.6 | 348 | hemin-binding periplasmic protein |
| 439 | 3939 | 413643 | 414710 | 1068 | gp: AF109162_2 | Corynebacterium diphtheriae hmuU | 65.2 | 90.3 | 330 | ABC transporter |
| 440 | 3940 | 414714 | 415526 | 813 | gp: AF109162_3 | Corynebacterium diphtheriae hmuV | 63.8 | 85.0 | 254 | ABC transporter ATP-binding protein |
| 441 | 3941 | 415643 | 416599 | 957 | gp: SCC75A_17 | Streptomyces coelicolor C75A SCC75A.17c | 28.6 | 56.4 | 266 | hypothetical protein |
| 442 | 3942 | 416603 | 417439 | 837 | gp: SCC75A_17 | Streptomyces coelicolor C75A SCC75A.17c | 32.6 | 61.6 | 258 | hypothetical protein |
| 443 | 3943 | 418354 | 417545 | 810 | | | | | | |
| 444 | 3944 | 419253 | 418441 | 813 | | | | | | |
| 445 | 3945 | 419757 | 419257 | 501 | | | | | | |
| 446 | 3946 | 419785 | 420885 | 1101 | gp: ECOMURBA_1 | Escherichia coli RDD012 murB | 30.1 | 58.4 | 356 | UDP-N-acetylpyruvoylglucosamine reductase |
| 447 | 3947 | 420866 | 421516 | 651 | | | | | | |
| 448 | 3948 | 421043 | 420309 | 735 | | | | | | |
| 449 | 3949 | 421858 | 422031 | 174 | | | | | | |
| 450 | 3950 | 423793 | 422090 | 1704 | sp: LCFA_BACSU | Bacillus subtilis lcfA | 35.5 | 68.1 | 558 | long-chain-fatty-acid—CoA ligase |
| 451 | 3951 | 423878 | 425131 | 1254 | gp: SC2G5_6 | Streptomyces coelicolor SC2G5.06 | 33.9 | 58.7 | 416 | transferase |
| 452 | 3952 | 425177 | 425920 | 744 | sp: PMGY_STRCO | Streptomyces coelicolor A3(2) gpm | 70.7 | 84.2 | 246 | phosphoglycerate mutase |
| 453 | 3953 | 425934 | 427172 | 1239 | prf: 2404434A | Mycobacterium bovis senX3 | 49.2 | 74.8 | 417 | two-component system sensor histidine kinase |
| 454 | 3954 | 427172 | 427867 | 696 | prf: 2404434B | Mycobacterium bovis BCG regX3 | 75.8 | 90.9 | 231 | two-component response regulator |
| 455 | 3955 | 428561 | 429439 | 879 | | | | | | |
| 456 | 3956 | 432023 | 429438 | 2586 | gp: SCE25_30 | Streptomyces coelicolor A3(2) SCE25.30 | 31.3 | 60.7 | 921 | ABC transporter ATP-binding protein |
| 457 | 3957 | 433028 | 432126 | 903 | sp: YV21_MYCTU | Mycobacterium tuberculosis H37Rv RV3121 | 45.0 | 66.9 | 269 | cytochrome P450 |
| 458 | 3958 | 433062 | 433988 | 927 | prf: 2512277A | Pseudomonas aeruginosa ppx | 28.8 | 57.8 | 306 | exopolyphosphatase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 459 | 3959 | 434010 | 434822 | 813 | sp: YV23_MYCTU | *Mycobacterium tuberculosis* H37Rv Rv0497 | 28.8 | 57.3 | 302 | hypothetical membrane protein |
| 460 | 3960 | 434886 | 435695 | 810 | sp: PROC_CORGL | *Corynebacterium glutamicum* ATCC 17965 proC | 100.0 | 100.0 | 269 | pyrroline-5-carboxylate reductase |
| 461 | 3961 | 434986 | 433865 | 1122 | gp: D88733_1 | Equine herpesvirus 1 ORF71 | 25.4 | 52.0 | 394 | membrane glycoprotein |
| 462 | 3962 | 435940 | 436137 | 198 | pir: S72921 | *Mycobacterium leprae* B2168_C1_172 | 76.4 | 94.6 | 55 | hypothetical protein |
| 463 | 3963 | 436321 | 436103 | 219 | gp: SCE68.25 | *Streptomyces coelicolor* SCE68.25c | 89.7 | 100.0 | 29 | hypothetical protein |
| 464 | 3964 | 436463 | 436561 | 99 | | | | | | |
| 465 | 3965 | 436573 | 436764 | 192 | pir: S72914 | *Mycobacterium leprae* MTCY20G9.32C. serB | 51.0 | 77.4 | 296 | phosphoserine phosphatase |
| 466 | 3966 | 437233 | 437850 | 618 | | | | | | |
| 467 | 3967 | 438044 | 436980 | 1065 | sp: YV35_MYCTU | *Mycobacterium tuberculosis* H37Rv Rv0508 | 40.5 | 66.2 | 74 | hypothetical protein |
| 468 | 3968 | 438179 | 438424 | 246 | | | | | | |
| 469 | 3969 | 438294 | 438037 | 258 | | | | | | |
| 470 | 3970 | 438816 | 439904 | 1389 | sp: HEM1_MYCLE | *Mycobacterium leprae* hemA | 44.4 | 74.3 | 455 | glutamyl-tRNA reductase |
| 471 | 3971 | 439909 | 440814 | 906 | pir: S72887 | *Mycobacterium leprae* hem3b | 50.7 | 75.3 | 308 | hydroxymethylbilane synthase |
| 472 | 3972 | 441220 | 441591 | 372 | | | | | | |
| 473 | 3973 | 442482 | 441601 | 882 | sp: CATM_ACICA | *Acinetobacter calcoaceticus* catM | 27.1 | 57.6 | 321 | cat operon transcriptional regulator |
| 474 | 3974 | 442758 | 444158 | 1401 | sp: SHIA_ECOLI | *Escherichia coli* K12 shiA | 35.5 | 72.2 | 417 | shikimate transport protein |
| 475 | 3975 | 444185 | 446038 | 1854 | sp: 3SHD_NEUCR | *Neurospora crassa* qa4 | 28.2 | 57.9 | 309 | 3-dehydroshikimate dehydratase |
| 476 | 3976 | 446538 | 447386 | 849 | sp: AF124518_2 | *Corynebacterium glutamicum* ASO19 aroE | 98.2 | 98.6 | 282 | shikimate dehydrogenase |
| 477 | 3977 | 447670 | 447398 | 273 | | | | | | |
| 478 | 3978 | 449179 | 448130 | 1050 | sp: POTG_ECOLI | *Escherichia coli* K12 potG | 34.7 | 68.6 | 363 | putrescine transport protein |
| 479 | 3979 | 449714 | 449100 | 615 | | | | | | |
| 480 | 3980 | 450826 | 449183 | 1644 | sp: SFUB_SERMA | *Serratia marcescens* sfuB | 25.1 | 55.2 | 578 | iron(III)-transport system permease protein |
| 481 | 3981 | 450849 | 451961 | 1113 | | | | | | |
| 482 | 3982 | 451895 | 450837 | 1059 | gp: SHU75349_1 | *Brachyspira hyodysenteriae* bitA | 25.1 | 59.9 | 347 | periplasmic-iron-binding protein |
| 483 | 3983 | 452661 | 454430 | 1770 | pir: S72909 | *Mycobacterium leprae* cysG | 46.5 | 71.6 | 486 | uroporphyrin-III C-methyltransferase |
| 484 | 3984 | 454450 | 454875 | 426 | | | | | | |
| 485 | 3985 | 454967 | 455983 | 1017 | sp: HEM2_STRCO | *Streptomyces coelicolor* A3(2) hemB | 60.8 | 83.1 | 337 | delta-aminolevulinic acid dehydratase |
| 486 | 3986 | 456016 | 456597 | 582 | | | | | | |
| 487 | 3987 | 456641 | 457150 | 510 | | | | | | |
| 488 | 3988 | 457357 | 459900 | 2544 | sp: CTPB_MYCLE | *Mycobacterium leprae* ctpB | 27.4 | 56.5 | 858 | cation-transporting P-type ATPase B |
| 489 | 3989 | 459425 | 458583 | 843 | sp: DCUP_STRCO | *Streptomyces coelicolor* A3(2) hemE | 55.0 | 76.7 | 364 | uroporphyrinogen decarboxylase |
| 490 | 3990 | 460020 | 461093 | 1074 | | | | | | |
| 491 | 3991 | 461112 | 462455 | 1344 | sp: PPOX_BACSU | *Bacillus subtilis* hemY | 28.0 | 59.9 | 464 | protoporphyrinogen IX oxidase |
| 492 | 3992 | 462557 | 463867 | 1311 | sp: GSA_MYCLE | *Mycobacterium leprae* hemL | 61.7 | 83.5 | 425 | glutamate-1-semialdehyde 2,1-aminomutase |
| 493 | 3993 | 463867 | 464472 | 606 | sp: PMG2_ECOLI | *Escherichia coli* K12 gpmB | 28.0 | 62.7 | 161 | phosphoglycerate mutase |
| 494 | 3994 | 464482 | 465102 | 621 | pir: A70545 | *Mycobacterium tuberculosis* H37Rv Rv0526 | 44.7 | 71.2 | 208 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 495 | 3995 | 465118 | 465909 | 792 | pir: B70545 | Mycobacterium tuberculosis H37Rv ccsA | 53.5 | 85.3 | 245 | cytochrome c-type biogenesis protein |
| 496 | 3996 | 465949 | 467571 | 1623 | pir: C70545 | Mycobacterium tuberculosis H37Rv Rv0528 | 50.7 | 76.0 | 533 | hypothetical membrane protein |
| 497 | 3997 | 467648 | 468658 | 1011 | pir: D70545 | Mycobacterium tuberculosis H37Rv ccsB | 44.1 | 77.8 | 338 | cytochrome c biogenesis protein |
| 498 | 3998 | 469370 | 470170 | 801 | pir: G70790 | Mycobacterium tuberculosis H37Rv Rv3678c pb5 | 38.9 | 69.4 | 144 | transcriptional regulator |
| 499 | 3999 | 470184 | 470654 | 471 | | | | | | |
| 500 | 4000 | 471013 | 470657 | 357 | prf: 2420312A | Staphylococcus aureus zntR | 31.1 | 72.2 | 90 | Zn/Co transport repressor |
| 501 | 4001 | 471420 | 471121 | 300 | | | | | | |
| 502 | 4002 | 471515 | 471847 | 333 | pir: F70545 | Mycobacterium tuberculosis H37Rv Rv0531 | 39.0 | 78.1 | 82 | hypothetical membrane protein |
| 503 | 4003 | 472808 | 471915 | 894 | sp: MENA_ECOLI | Escherichia coli K12 menA | 33.6 | 61.5 | 301 | 1,4-dihydroxy-2-naphthoate octaprenyltransferase |
| 504 | 4004 | 472948 | 473811 | 864 | gp: AF125164_6 | Bacteroides fragilis wcgB | 32.4 | 62.6 | 238 | glycosyl transferase |
| 505 | 4005 | 475136 | 473814 | 1323 | prf: 2423270B | Rhizobium trifolii matB | 25.4 | 51.5 | 421 | malonyl-CoA-decarboxylase |
| 506 | 4006 | 475407 | 474997 | 411 | sp: YQJF_ECOLI | Escherichia coli K12 yqjF | 35.3 | 65.5 | 139 | hypothetical membrane protein |
| 507 | 4007 | 477048 | 475489 | 1560 | pir: S27612 | Pseudomonas putida | 50.4 | 76.0 | 520 | ketoglutarate semialdehyde dehydrogenase |
| 508 | 4008 | 477995 | 477048 | 948 | sp: KDGD_PSEPU | Pseudomonas putida KDGDH | 48.5 | 75.6 | 303 | 5-dehydro-4-deoxyglucarate dehydratase |
| 509 | 4009 | 478970 | 478092 | 879 | sp: ALSR_BACSU | Bacillus subtilis 168 alsR | 36.9 | 66.2 | 293 | als operon regulatory protein |
| 510 | 4010 | 479303 | 478989 | 315 | pir: B70547 | Mycobacterium tuberculosis H37Rv Rv0543c | 33.0 | 64.9 | 94 | hypothetical protein |
| 511 | 4011 | 480154 | 480597 | 444 | | | | | | |
| 512 | 4012 | 480201 | 479452 | 750 | gp: SSP277295_9 | Sphingomonas sp. LB126 fldB | 28.1 | 54.7 | 267 | 2-pyrone-4,6-dicarboxylic acid |
| 513 | 4013 | 480624 | 480208 | 417 | | | | | | |
| 514 | 4014 | 481001 | 480624 | 378 | | | | | | |
| 515 | 4015 | 481391 | 481131 | 261 | | | | | | |
| 516 | 4016 | 482668 | 481394 | 1275 | pir: D70547 | Mycobacterium tuberculosis H37Rv pitA | 60.0 | 83.2 | 410 | low-affinity inorganic phosphate transporter |
| 517 | 4017 | 483587 | 483366 | 222 | | | | | | |
| 518 | 4018 | 483942 | 483637 | 306 | | | | | | |
| 519 | 4019 | 485062 | 484106 | 957 | sp: MENB_BACSU | Bacillus subtilis menB | 48.5 | 70.3 | 293 | naphthoate synthase |
| 520 | 4020 | 485384 | 485986 | 603 | gp: AE001957_12 | Deinococcus radiodurans DR1070 | 57.9 | 82.7 | 202 | peptidase E |
| 521 | 4021 | 485385 | 485077 | 309 | pir: C70304 | Aquifex aeolicus VF5 phhB | 37.7 | 68.8 | 77 | pterin-4a-carbinolamine dehydratase |
| 522 | 4022 | 486001 | 487014 | 1014 | pir: D70548 | Mycobacterium tuberculosis H37Rv Rv0553 menC | 54.0 | 76.7 | 335 | muconate cycloisomerase |
| 523 | 4023 | 487028 | 488656 | 1629 | sp: MEND_BACSU | Bacillus subtilis menD | 29.4 | 54.0 | 606 | 2-oxoglutarate decarboxylase and 2-succinyl-6-hydroxy-2,4-cyclohexadiene-1-carboxylate synthase |
| 524 | 4024 | 488660 | 489100 | 441 | pir: G70548 | Mycobacterium tuberculosis H37Rv Rv0556 | 37.2 | 64.9 | 148 | hypothetical membrane protein |
| 525 | 4025 | 489209 | 490447 | 1239 | pir: H70548 | Mycobacterium tuberculosis H37Rv pimB | 22.8 | 54.2 | 408 | alpha-D-mannose-alpha(1-6) phosphatidyl myo-inositol monomannoside transferase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 526 | 4026 | 490580 | 491938 | 1359 | sp: CYCA_ECOLI | *Escherichia coli* K12 cycA | 66.2 | 89.9 | 447 | D-serine/D-alanine/glycine transporter |
| 527 | 4027 | 491966 | 492655 | 690 | sp: UBIE_ECOLI | *Escherichia coli* K12 ubiE | 37.1 | 66.7 | 237 | ubiquinone/menaquinone biosynthesis methyltransferase |
| 528 | 4028 | 492915 | 493583 | 669 | | | | | | oxidoreductase |
| 529 | 4029 | 493916 | 492645 | 1272 | | | 49.0 | 76.7 | 412 | |
| 530 | 4030 | 494061 | 495110 | 1050 | pir: D70549 | *Mycobacterium tuberculosis* H37Rv Rv0561c | 39.2 | 67.1 | 316 | heptaprenyl diphosphate synthase component II |
| 531 | 4031 | 496810 | 497142 | 333 | sp: HEP2_BACST | *Bacillus stearothermophilus* ATCC 10149 hepT | 100.0 | 100.0 | 111 | preprotein translocase SecE subunit |
| 532 | 4032 | 497374 | 498327 | 954 | gp: AF130462_2 | *Corynebacterium glutamicum* ATCC 13032 secE | 100.0 | 100.0 | 318 | transcriptional antiterminator protein |
| 533 | 4033 | 498598 | 499032 | 435 | gp: AF130462_3 | *Corynebacterium glutamicum* ATCC 13032 nusG | 100.0 | 100.0 | 145 | 50S ribosomal protein L11 |
| 534 | 4034 | 499162 | 499869 | 708 | gp: AF130462_4 | *Corynebacterium glutamicum* ATCC 13032 rplK | 100.0 | 100.0 | 236 | 50S ribosomal protein L1 |
| 535 | 4035 | 501436 | 499925 | 1512 | gp: AF130462_5 | *Corynebacterium glutamicum* ATCC 13032 rplA | 23.1 | 50.2 | 564 | regulatory protein |
| 536 | 4036 | 501577 | 502920 | 1344 | gp: SC5H4_2 | *Streptomyces coelicolor* SC5H4.02 | 60.5 | 82.4 | 443 | 4-aminobutyrate aminotransferase |
| 537 | 4037 | 502925 | 504283 | 1359 | sp: GABT_MYCTU | *Mycobacterium tuberculosis* H37Rv RV2589 gabT | 40.8 | 71.8 | 461 | succinate-semialdehyde dehydrogenase (NAD(P)+) |
| 538 | 4038 | 503739 | 503272 | 468 | sp: GABD_ECOLI | *Escherichia coli* K12 gabD | 32.0 | 38.0 | 150 | novel two-component regulatory system |
| 539 | 4039 | 504379 | 505569 | 1191 | GP: ABCARRA_2 | *Azospirillum brasilense* carR | 25.5 | 49.9 | 447 | tyrosine-specific transport protein |
| 540 | 4040 | 505698 | 507647 | 1950 | sp: TYRP_ECOLI | *Escherichia coli* K12 o341#7 tyrP | 33.2 | 64.4 | 615 | cation-transporting ATPase G |
| 541 | 4041 | 507669 | 509081 | 1413 | sp: CTPG_MYCTU | *Mycobacterium tuberculosis* H37Rv RV1992C ctpG | 40.2 | 66.2 | 468 | hypothetical protein or dehydrogenase |
| 542 | 4042 | 509094 | 509696 | 603 | sp: P49_STRLI | *Streptomyces lividans* P49 | | | | |
| 543 | 4043 | 509998 | 510510 | 513 | sp: RL10_STRGR | *Streptomyces griseus* N2-3-11 rplJ | 52.9 | 84.7 | 170 | 50S ribosomal protein L10 |
| 544 | 4044 | 510591 | 510974 | 384 | sp: RL7_MYCTU | *Mycobacterium tuberculosis* H37Rv RV0652 rplL | 72.3 | 89.2 | 130 | 50S ribosomal protein L7/L12 |
| 545 | 4045 | 511126 | 510989 | 138 | pir: A70962 | *Mycobacterium tuberculosis* H37Rv Rv0227c | 25.8 | 55.5 | 283 | hypothetical membrane protein |
| 546 | 4046 | 511536 | 512507 | 972 | | | | | | |
| 547 | 4047 | 512913 | 516407 | 3495 | sp: RPOB_MYCTU | *Mycobacterium tuberculosis* H37Rv Rv0667 rpoB | 75.4 | 90.4 | 1180 | DNA-directed RNA polymerase beta chain |
| 548 | 4048 | 516494 | 520492 | 3999 | sp: RPOC_MYCTU | *Mycobacterium tuberculosis* H37Rv Rv0668 rpoC | 72.9 | 88.7 | 1332 | DNA-directed RNA polymerase beta chain |
| 549 | 4049 | 519277 | 518696 | 582 | GP: AF121004_1 | *Mycobacterium tuberculosis* H37Rv Iv0166c | 39.0 | 52.0 | 169 | hypothetical protein |
| 550 | 4050 | 520671 | 520850 | 180 | | | | | | |
| 551 | 4051 | 520865 | 521644 | 780 | gp: SCJ9A_15 | *Streptomyces coelicolor* A3(2) SCJ9A.15c | 39.2 | 63.8 | 232 | DNA-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 552 | 4052 | 522476 | 521679 | 798 | sp: YT08_MYCTU | Mycobacterium tuberculosis H37Rv RV2908C | 29.3 | 57.7 | 215 | hypothetical protein |
| 553 | 4053 | 522694 | 523059 | 366 | sp: RS12_MYCIT | Mycobacterium intracellulare rpsL | 90.9 | 97.5 | 121 | 30S ribosomal protein S12 |
| 554 | 4054 | 523069 | 523533 | 465 | sp: RS7_MYCSM | Mycobacterium smegmatis LR222 rpsG | 81.8 | 94.8 | 154 | 30S ribosomal protein S7 |
| 555 | 4055 | 523896 | 526010 | 2115 | sp: EFG_MICLU | Micrococcus luteus fusA | 71.7 | 88.9 | 709 | elongation factor G |
| 556 | 4056 | 526070 | 523911 | 2160 | | | | | | |
| 557 | 4057 | 526156 | 526013 | 144 | | | | | | |
| 558 | 4058 | 527121 | 526894 | 228 | GSP: Y37841 | Chlamydia trachomatis | 56.0 | 78.0 | 44 | lipoprotein |
| 559 | 4059 | 527759 | 527607 | 153 | | | | | | |
| 560 | 4060 | 528040 | 528768 | 729 | | | | | | |
| 561 | 4061 | 529570 | 528779 | 792 | sp: FEPC_ECOLI | Escherichia coli K12 fepC | 56.2 | 83.7 | 258 | ferric enterobactin transport ATP-binding protein |
| 562 | 4062 | 530626 | 529592 | 1035 | sp: FEPG_ECOLI | Escherichia coli K12 fepG | 45.6 | 77.8 | 329 | ferric enterobactin transport protein |
| 563 | 4063 | 531782 | 530748 | 1035 | sp: FEPD_ECOLI | Escherichia coli K12 fepD | 48.1 | 80.6 | 335 | ferric enterobactin transport protein |
| 564 | 4064 | 532008 | 532523 | 516 | gp: CTACTAGEN_1 | Thermoanaerobacterium thermosaccharolyticum actA | 56.6 | 79.3 | 145 | butyryl-CoA: acetate coenzyme A transferase |
| 565 | 4065 | 533099 | 533401 | 303 | sp: RS10_PLARO | Planobispora rosea ATCC 53733 rpsJ | 84.2 | 99.0 | 101 | 30S ribosomal protein S10 |
| 566 | 4066 | 533437 | 534090 | 654 | sp: RL3_MYCBO | Mycobacterium bovis BCG rplC | 66.5 | 89.6 | 212 | 50S ribosomal protein L3 |
| 567 | 4067 | 534087 | 533401 | 687 | | | | | | |
| 568 | 4068 | 534090 | 534743 | 654 | sp: RL4_MYCBO | Mycobacterium bovis BCG rplD | 71.2 | 90.1 | 212 | 50S ribosomal protein L4 |
| 569 | 4069 | 534746 | 535048 | 303 | sp: RL23_MYCBO | Mycobacterium bovis BCG rplW | 74.0 | 90.6 | 96 | 50S ribosomal protein L23 |
| 570 | 4070 | 535072 | 534746 | 327 | | | | | | |
| 571 | 4071 | 535076 | 535915 | 840 | sp: RL2_MYCLE | Mycobacterium bovis BCG rplB | 80.7 | 92.9 | 280 | 50S ribosomal protein L2 |
| 572 | 4072 | 535935 | 536210 | 276 | sp: RS19_MYCTU | Mycobacterium tuberculosis H37Rv Rv0705 rpsS | 87.0 | 98.9 | 92 | 30S ribosomal protein S19 |
| 573 | 4073 | 536183 | 535899 | 285 | | | | | | |
| 574 | 4074 | 536217 | 536576 | 360 | sp: RL22_MYCTU | Mycobacterium tuberculosis H37Rv Rv0706 rplV | 74.3 | 91.7 | 109 | 50S ribosomal protein L22 |
| 575 | 4075 | 536579 | 537322 | 744 | sp: RS3_MYCBO | Mycobacterium bovis BCG rpsC | 77.4 | 91.2 | 239 | 30S ribosomal protein S3 |
| 576 | 4076 | 537328 | 537741 | 414 | sp: RL16_MYCBO | Mycobacterium bovis BCG rplP | 69.3 | 88.3 | 137 | 50S ribosomal protein L16 |
| 577 | 4077 | 537744 | 537971 | 228 | sp: RL29_MYCBO | Mycobacterium bovis BCG rpmC | 65.7 | 88.1 | 67 | 50S ribosomal protein L29 |
| 578 | 4078 | 537977 | 538252 | 276 | sp: RS17_MYCBO | Mycobacterium bovis BCG rpsQ | 69.5 | 89.0 | 82 | 30S ribosomal protein S17 |
| 579 | 4079 | 538267 | 537974 | 294 | | | | | | |
| 580 | 4080 | 538698 | 538381 | 318 | | | | | | |
| 581 | 4081 | 539413 | 538718 | 696 | | | | | | |
| 582 | 4082 | 539741 | 540106 | 366 | sp: RL14_MYCTU | Mycobacterium tuberculosis H37Rv Rv0714 rplN | 83.6 | 95.1 | 122 | 50S ribosomal protein L14 |
| 583 | 4083 | 540112 | 540423 | 312 | sp: RL24_MYCTU | Mycobacterium tuberculosis H37Rv Rv0715 rplX | 76.2 | 91.4 | 105 | 50S ribosomal protein L24 |
| 584 | 4084 | 540426 | 540998 | 573 | sp: RL5_MICLU | Micrococcus luteus rplE | 73.6 | 92.3 | 183 | 50S ribosomal protein L5 |
| 585 | 4085 | 541048 | 542079 | 1032 | | | | | | |
| 586 | 4086 | 542896 | 542090 | 807 | sp: 2DKG_CORSP | Corynebacterium sp. | 52.3 | 74.2 | 260 | 2,5-diketo-D-gluconic acid reductase |
| 587 | 4087 | 543412 | 542921 | 492 | | | | | | |
| 588 | 4088 | 544329 | 543415 | 915 | sp: FDHD_WOLSU | Wolinella succinogenes fdhD | 28.9 | 59.7 | 298 | formate dehydrogenase chain D |
| 589 | 4089 | 544670 | 544335 | 336 | gp: SCGD3_29 | Streptomyces coelicolor A3(2) SCGD3.29c | 37.2 | 68.1 | 94 | molybdopterin-guanine dinucleotide biosynthesis protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 590 | 4090 | 546889 | 544757 | 2133 | sp: FDHF_ECOLI | Escherichia coli fdhF | 24.3 | 53.4 | 756 | formate dehydrogenase H or alpha chain |
| 591 | 4091 | 547329 | 548084 | 756 | | | | | | |
| 592 | 4092 | 548990 | 548187 | 804 | | | | | | |
| 593 | 4093 | 550651 | 548990 | 1662 | sp: YC81_MYCTU | Mycobacterium tuberculosis H37Rv Rv1281c oppD | 26.9 | 52.6 | 624 | ABC transporter ATP-binding protein |
| 594 | 4094 | 551844 | 550699 | 1146 | | | | | | |
| 595 | 4095 | 552927 | 551854 | 1074 | | | | | | hypothetical protein |
| 596 | 4096 | 554129 | 552948 | 1182 | pir: E69424 | Archaeoglobus fulgidus AF1398 | 24.7 | 50.4 | 405 | hypothetical protein |
| 597 | 4097 | 554919 | 554452 | 468 | gp: AE001931_13 | Deinococcus radiodurans DR0763 | 42.7 | 66.7 | 150 | |
| 598 | 4098 | 555331 | 555726 | 396 | pir: S29885 | Micrococcus luteus | 75.8 | 97.7 | 132 | 30S ribosomal protein S8 |
| 599 | 4099 | 555749 | 556282 | 534 | pir: S29886 | Micrococcus luteus | 59.2 | 87.7 | 179 | 50S ribosomal protein L6 |
| 600 | 4100 | 556289 | 556690 | 402 | sp: RL18_MICLU | Micrococcus luteus rplR | 67.3 | 90.9 | 110 | 50S ribosomal protein L18 |
| 601 | 4101 | 556734 | 557366 | 633 | sp: RS5_MICLU | Micrococcus luteus rpsE | 67.8 | 88.3 | 171 | 30S ribosomal protein S5 |
| 602 | 4102 | 557373 | 557555 | 183 | sp: RL30_ECOLI | Escherichia coli K12 rpmJ | 54.6 | 76.4 | 55 | 50S ribosomal protein L30 |
| 603 | 4103 | 557565 | 558008 | 444 | sp: RL15_MICLU | Micrococcus luteus rplO | 66.4 | 87.4 | 143 | 50S ribosomal protein L15 |
| 604 | 4104 | 557588 | 556860 | 729 | | | | | | |
| 605 | 4105 | 558517 | 558197 | 321 | prf: 2204281A | Streptomyces coelicolor msdA | 46.9 | 68.8 | 128 | methylmalonic acid semialdehyde dehydrogenase |
| 606 | 4106 | 558969 | 558607 | 363 | | | | | | |
| 607 | 4107 | 559805 | 560260 | 456 | GP: ABCARRA_2 | Azospirillum brasilense carR | 47.0 | 52.0 | 125 | novel two-component regulatory system |
| 608 | 4108 | 560634 | 559144 | 1491 | prf: 2516398E | Rhodococcus rhodochrous plasmid pRTL1 orf5 | 41.7 | 71.5 | 487 | aldehyde dehydrogenase or betaine aldehyde dehydrogenase |
| 609 | 4109 | 561368 | 560634 | 735 | | | | | | |
| 610 | 4110 | 562632 | 562937 | 306 | | | | | | |
| 611 | 4111 | 562633 | 561366 | 1266 | prf: 2411257B | Sphingomonas sp. redA2 | 41.1 | 71.6 | 409 | reductase |
| 612 | 4112 | 562963 | 562646 | 318 | prf: 2313248B | Rhodobacter capsulatus fdxE | 47.7 | 66.4 | 107 | 2Fe2S ferredoxin |
| 613 | 4113 | 563736 | 562993 | 744 | gp: PPU24215_2 | Pseudomonas putida cymB | 35.8 | 70.8 | 257 | p-cumic alcohol dehydrogenase |
| 614 | 4114 | 563871 | 564083 | 213 | PIR: H72754 | Aeropyrum pernix K1 APE0029 | 50.0 | 56.0 | 50 | hypothetical protein |
| 615 | 4115 | 565471 | 563732 | 1740 | pir: JC4176 | Pyrococcus furiosus Vc1 DSM 3638 ppsA | 22.9 | 45.0 | 629 | phosphoenolpyruvate synthetase |
| 616 | 4116 | 566759 | 565680 | 1080 | pir: JC4176 | Pyrococcus furiosus Vc1 DSM 3638 ppsA | 38.6 | 66.7 | 378 | phosphoenolpyruvate synthetase |
| 617 | 4117 | 568088 | 566799 | 1290 | prf: 2104333G | Rhodococcus erythropolis thcB | 34.8 | 65.2 | 422 | cytochrome P450 |
| 618 | 4118 | 569075 | 568272 | 804 | prf: 2512309A | Erwinia carotovora carotovora kdgR | 28.5 | 66.0 | 256 | transcriptional repressor |
| 619 | 4119 | 570774 | 571316 | 543 | sp: KAD_MICLU | Micrococcus luteus adk | 48.9 | 81.0 | 184 | adenylate kinase |
| 620 | 4120 | 571367 | 570756 | 612 | | | | | | |
| 621 | 4121 | 571476 | 572267 | 792 | sp: AMPM_BACSU | Bacillus subtilis 168 map | 43.1 | 74.7 | 253 | methionine aminopeptidase |
| 622 | 4122 | 572349 | 573176 | 828 | | | | | | |
| 623 | 4123 | 573407 | 573622 | 216 | pir: F69644 | Bacillus subtilis infA | 77.0 | 86.0 | 72 | translation initiation factor IF-1 |
| 624 | 4124 | 573816 | 574181 | 366 | prf: 2505353B | Thermus thermophilus HB8 rps13 | 66.4 | 91.0 | 122 | 30S ribosomal protein S13 |
| 625 | 4125 | 574187 | 574588 | 402 | sp: RS11_STRCO | Streptomyces coelicolor A3(2) SC6G4.06. rpsK | 81.3 | 93.3 | 134 | 30S ribosomal protein S11 |
| 626 | 4126 | 574615 | 575217 | 603 | prf: 2211287F | Mycobacterium tuberculosis H37Rv RV3458C rpsD | 82.6 | 93.9 | 132 | 30S ribosomal protein S4 |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 627 | 4127 | 575338 | 576351 | 1014 | sp: RPOA_BACSU | Bacillus subtilis 168 rpoA | 51.1 | 77.8 | 311 | RNA polymerase alpha subunit |
| 628 | 4128 | 575366 | 575211 | 156 | | | | | | |
| 629 | 4129 | 576410 | 576898 | 489 | sp: RL17_ECOLI | Escherichia coli K12 rplQ | 51.6 | 77.1 | 122 | 50S ribosomal protein L17 |
| 630 | 4130 | 577057 | 577923 | 867 | sp: TRUA_ECOLI | Escherichia coli k12 truA | 37.0 | 61.1 | 265 | pseudouridylate synthase A |
| 631 | 4131 | 578033 | 580429 | 2397 | pir: G70695 | Mycobacterium tuberculosis H37Rv Rv3779 | 24.8 | 51.2 | 786 | hypothetical membrane protein |
| 632 | 4132 | 580891 | 580436 | 456 | | | | | | |
| 633 | 4133 | 581221 | 580919 | 303 | | | | | | |
| 634 | 4134 | 581406 | 582662 | 1257 | pir: A70836 | Mycobacterium tuberculosis H37Rv Rv0283 | 27.4 | 53.8 | 485 | hypothetical protein |
| 635 | 4135 | 582684 | 584228 | 1545 | sp: DIM_ARATH | Arabidopsis thaliana CV DIM | 22.8 | 50.9 | 505 | cell elongation protein |
| 636 | 4136 | 584268 | 585620 | 1353 | sp: CFA_ECOLI | Escherichia coli K12 cfa | 30.7 | 56.0 | 423 | cyclopropane-fatty-acyl-phospholipid synthase |
| 637 | 4137 | 585823 | 586248 | 426 | gp: SCL2_30 | Streptomyces coelicolor A3(2) SCL2.30c | 28.0 | 59.0 | 100 | hypothetical membrane protein |
| 638 | 4138 | 587757 | 586399 | 1359 | sp: ELYA_BACAO | Bacillus alcalophilus | 31.3 | 58.0 | 273 | high-alkaline serine proteinase |
| 639 | 4139 | 589015 | 587645 | 1371 | pir: T10930 | Streptomyces coelicolor A3(2) SC3C3.21 | 24.0 | 50.6 | 516 | hypothetical membrane protein |
| 640 | 4140 | 589296 | 592862 | 3567 | pir: E70977 | Mycobacterium tuberculosis H37Rv Rv3447c | 65.0 | 38.4 | 1260 | hypothetical membrane protein |
| 641 | 4141 | 590411 | 589590 | 822 | | | | | | |
| 642 | 4142 | 590560 | 589898 | 663 | | | | | | |
| 643 | 4143 | 592862 | 593761 | 900 | | | | | | |
| 644 | 4144 | 593935 | 594258 | 324 | pir: C70977 | Mycobacterium tuberculosis H37Rv Rv3445c | 31.1 | 69.9 | 103 | hypothetical protein |
| 645 | 4145 | 594293 | 594580 | 288 | prf: 2111376A | Mycobacterium tuberculosis | 36.3 | 81.3 | 80 | early secretory antigen target ESAT-6 protein |
| 646 | 4146 | 594939 | 595379 | 441 | sp: RL13_STRCO | Streptomyces coelicolor A3(2) SC6G4.12. rplM | 58.6 | 82.1 | 145 | 50S ribosomal protein L13 |
| 647 | 4147 | 595382 | 595927 | 546 | sp: RS9_STRCO | Streptomyces coelicolor A3(2) SG6G4.13. rpsI | 49.2 | 72.4 | 181 | 30S ribosomal protein S9 |
| 648 | 4148 | 596109 | 597449 | 1341 | prf: 2320260A | Staphylococcus aureus femR315 | 48.9 | 76.4 | 450 | phosphoglucosamine mutase |
| 649 | 4149 | 597892 | 598194 | 303 | | | | | | |
| 650 | 4150 | 598194 | 599702 | 1509 | pir: S75138 | Synechocystis sp. PCC6803 slr1753 | 29.3 | 45.6 | 318 | hypothetical protein |
| 651 | 4151 | 599350 | 598778 | 573 | | | | | | |
| 652 | 4152 | 599699 | 599932 | 234 | | | | | | |
| 653 | 4153 | 600876 | 600022 | 855 | pir: S73000 | Mycobacterium leprae B229_F1_20 | 44.0 | 72.2 | 259 | hypothetical protein |
| 654 | 4154 | 600971 | 602053 | 1083 | sp: ALR_MYCTU | Mycobacterium tuberculosis H37Rv RV3423C alr | 41.6 | 68.5 | 368 | alanine racemase |
| 655 | 4155 | 602080 | 602574 | 495 | sp: Y097_MYCTU | Mycobacterium tuberculosis H37Rv RV3422c | 48.7 | 78.6 | 154 | hypothetical protein |
| 656 | 4156 | 602811 | 604409 | 1599 | sp: YIDE_ECOLI | Escherichia coli K12 yidE | 28.9 | 66.2 | 550 | hypothetical membrane protein |
| 657 | 4157 | 604470 | 605708 | 1239 | gp: PSJ00161_1 | Propionibacterium shermanii pip | 51.3 | 77.6 | 411 | proline iminopeptidase |
| 658 | 4158 | 605718 | 606392 | 675 | sp: Y098_MYCTU | Mycobacterium tuberculosis H37Rv Rv3421c | 52.2 | 75.4 | 207 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 659 | 4159 | 606392 | 606898 | 507 | sp: RIMI_ECOLI | Escherichia coli K12 rimI | 30.3 | 59.9 | 132 | ribosomal-protein-alanine N-acetyltransferase |
| 660 | 4160 | 606905 | 607936 | 1032 | sp: GCP_PASHA | Pasteurella haemolytica SEROTYPE A1 gcp | 46.1 | 75.2 | 319 | O-sialoglycoprotein endopeptidase |
| 661 | 4161 | 607958 | 609679 | 1722 | sp: Y115_MYCTU | Mycobacterium tuberculosis H37Rv Rv3433c | 38.4 | 59.4 | 571 | hypothetical protein |
| 662 | 4162 | 609747 | 610175 | 429 | | | | | | |
| 663 | 4163 | 610268 | 609816 | 453 | | | | | | |
| 664 | 4164 | 610348 | 610644 | 297 | sp: CH10_MYCTU | Mycobacterium tuberculosis H37Rv Rv3418C mopB | 76.0 | 94.0 | 100 | heat shock protein groES |
| 665 | 4165 | 610659 | 612272 | 1614 | sp: CH61_MYCLE | Mycobacterium leprae B229_C3_248 groE1 | 63.3 | 85.1 | 537 | heat shock protein groEL |
| 666 | 4166 | 611200 | 610946 | 255 | GP: MSGTCWPA_1 | Mycobacterium tuberculosis | 50.0 | 56.0 | 76 | hypothetical protein |
| 667 | 4167 | 612266 | 611109 | 1158 | GP: MSGTCWPA_3 | Mycobacterium smegmatis | 34.0 | 45.0 | 138 | hypothetical protein |
| 668 | 4168 | 612714 | 612418 | 297 | gp: AF073300_1 | whiB3 | 64.9 | 88.3 | 94 | regulatory protein |
| 669 | 4169 | 613156 | 613719 | 564 | sp: Y09F_MYCTU | Mycobacterium tuberculosis H37Rv Rv3414c sigD | 55.2 | 81.6 | 174 | RNA polymerase sigma factor |
| 670 | 4170 | 613722 | 614747 | 1026 | sp: Y09H_MYCLE | Mycobacterium leprae B1620_F3_131 | 41.4 | 69.8 | 116 | hypothetical protein |
| 671 | 4171 | 615180 | 614803 | 378 | | | | | | |
| 672 | 4172 | 615536 | 616853 | 1518 | gp: AB003154_1 | Corynebacterium ammoniagenes ATCC 6872 guaB | 80.8 | 93.9 | 504 | IMP dehydrogenase |
| 673 | 4173 | 616231 | 615605 | 627 | PIR: F71456 | Pyrococcus horikoshii PH0308 | 39.0 | 53.0 | 146 | hypothetical protein |
| 674 | 4174 | 616973 | 618094 | 1122 | gp: AB003154_2 | Corynebacterium ammoniagenes ATCC 6872 | 70.9 | 86.1 | 381 | IMP dehydrogenase |
| 675 | 4175 | 619013 | 618093 | 921 | sp: YBIF_ECOLI | Escherichia coli K12 ybiF | 38.0 | 67.5 | 274 | hypothetical membrane protein |
| 676 | 4176 | 619086 | 619994 | 909 | prf: 1516239A | Bacillus subtilis gltC | 29.0 | 58.4 | 262 | glutamate synthetase positive regulator |
| 677 | 4177 | 620004 | 621572 | 1569 | sp: GUAA_CORAM | Corynebacterium ammoniagenes guaA | 81.6 | 92.8 | 517 | GMP synthetase |
| 678 | 4178 | 620926 | 620264 | 663 | | | | | | |
| 679 | 4179 | 621717 | 622157 | 441 | | | | | | |
| 680 | 4180 | 622269 | 622457 | 189 | | | | | | |
| 681 | 4181 | 623635 | 622460 | 1176 | gp: SCD63_22 | Streptomyces coelicolor A3(2) | 20.5 | 39.6 | 513 | hypothetical membrane protein |
| 682 | 4182 | 623800 | 624939 | 1140 | gp: SC6E10_15 | Streptomyces coelicolor A3(2) SC6E10.15c | 26.8 | 48.7 | 411 | two-component system sensor histidine kinase |
| 683 | 4183 | 624985 | 625674 | 690 | sp: DEGU_BACSU | Bacillus subtilis 168 degU | 33.5 | 65.1 | 218 | transcriptional regulator or extracellular proteinase response regulator |
| 684 | 4184 | 625677 | 626000 | 324 | | | | | | |
| 685 | 4185 | 626558 | 626070 | 489 | | | | | | |
| 686 | 4186 | 627539 | 626577 | 963 | | | | | | |
| 687 | 4187 | 627727 | 628551 | 825 | pir: B70975 | Mycobacterium tuberculosis H37Rv Rv3395c | 30.9 | 64.2 | 201 | hypothetical protein |
| 688 | 4188 | 628551 | 630140 | 1590 | pir: A70975 | Mycobacterium tuberculosis H37Rv Rv3394c | 37.5 | 64.1 | 563 | hypothetical protein |
| 689 | 4189 | 630810 | 630151 | 660 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 690 | 4190 | 630949 | 631809 | 861 | gp: SC5B8_20 | *Streptomyces coelicolor* A3(2) SC5B8.20c | 33.8 | 62.9 | 275 | hypothetical protein |
| 691 | 4191 | 632684 | 631824 | 861 | gp: AE001935_7 | *Deinococcus radiodurans* DR0809 | 27.8 | 58.3 | 288 | hypothetical membrane protein |
| 692 | 4192 | 633079 | 632690 | 390 | | | | | | |
| 693 | 4193 | 633474 | 633079 | 396 | gp: MMU92075_3 | *Mycobacterium maritum* | 36.8 | 67.4 | 95 | hypothetical membrane protein |
| 694 | 4194 | 635175 | 633532 | 1644 | gp: AF139916_3 | *Brevibacterium linens* ATCC 9175 crtI | 50.4 | 76.2 | 524 | phytoene desaturase |
| 695 | 4195 | 636089 | 635178 | 912 | gp: AF139916_2 | *Brevibacterium linens* ATCC 9175 crtB | 42.0 | 71.2 | 288 | phytoene synthase |
| 696 | 4196 | 638278 | 636089 | 2190 | gp: SCF43A_29 | *Streptomyces coelicolor* A3(2) SCF43A.29c | 48.6 | 75.6 | 722 | transmembrane transport protein |
| 697 | 4197 | 639462 | 638317 | 1146 | gp: AF139916_11 | *Brevibacterium linens* crtE | 32.7 | 63.8 | 367 | geranylgeranyl pyrophosphate (GGPP) synthase |
| 698 | 4198 | 639624 | 640208 | 585 | gp: AF139916_14 | *Brevibacterium linens* | 38.3 | 68.1 | 188 | transcriptional regulator (MarR family) |
| 699 | 4199 | 640879 | 640232 | 648 | sp: BLC_CITFR | *Citrobacter freundii* blc OS60 blc | 33.1 | 62.1 | 145 | outer membrane lipoprotein |
| 700 | 4200 | 641133 | 642557 | 1425 | gp: AF139916_1 | *Brevibacterium linens* | 48.7 | 74.2 | 462 | hypothetical protein |
| 701 | 4201 | 643959 | 642556 | 1404 | gp: AF139916_5 | *Brevibacterium linens* ATCC 9175 cpd1 | 40.0 | 63.2 | 497 | DNA photolyase |
| 702 | 4202 | 644026 | 644778 | 753 | gp: AF155804_7 | *Streptococcus suis* cps1K | 25.9 | 53.7 | 205 | glycosyl transferase |
| 703 | 4203 | 647590 | 645176 | 2415 | gp: SCE25_30 | *Streptomyces coelicolor* A3(2) SCE25.30 | 24.3 | 54.9 | 897 | ABC transporter |
| 704 | 4204 | 648309 | 647593 | 717 | prf: 2420410P | *Bacillus subtilis* 168 yvrO | 35.4 | 72.2 | 223 | ABC transporter |
| 705 | 4205 | 648467 | 648315 | 153 | | | | | | |
| 706 | 4206 | 649105 | 648440 | 666 | prf: 2320284D | *Helicobacter pylori* abcD | 35.9 | 75.2 | 206 | ABC transporter |
| 707 | 4207 | 649342 | 650187 | 846 | | | | | | |
| 708 | 4208 | 650193 | 649114 | 1080 | sp: ABC_ECOLI | *Escherichia coli* TAP90 abc | 43.6 | 75.4 | 346 | ABC transporter |
| 709 | 4209 | 651288 | 650392 | 897 | sp: HLPA_HAEIN | *Haemophilus influenzae* SEROTYPE B hlpA | 28.7 | 67.2 | 268 | lipoprotein |
| 710 | 4210 | 651601 | 654612 | 3012 | pfr: 2517386A | *Thermus aquaticus* dnaE | 30.2 | 57.5 | 1101 | DNA polymerase III |
| 711 | 4211 | 654676 | 655122 | 447 | gp: SCE126_11 | *Streptomyces coelicolor* A3(2) SCE126.11 | 41.5 | 62.3 | 159 | hypothetical protein |
| 712 | 4212 | 655122 | 656534 | 1413 | gp: SCE9_1 | *Streptomyces coelicolor* A3(2) SCE9.01 | 26.1 | 56.0 | 468 | hypothetical membrane protein |
| 713 | 4213 | 655834 | 655097 | 738 | | | | | | |
| 714 | 4214 | 656647 | 657215 | 669 | pir: C70884 | *Mycobacterium tuberculosis* H37Rv Rv2788 sirR | 50.3 | 76.4 | 203 | transcriptional repressor |
| 715 | 4215 | 658002 | 657205 | 798 | gp: SCG8A_5 | *Streptomyces coelicolor* A3(2) SCG8A.05c | 34.9 | 61.7 | 264 | hypothetical protein |
| 716 | 4216 | 658005 | 658142 | 138 | | | | | | |
| 717 | 4217 | 658155 | 658928 | 774 | pir: C69459 | *Archaeoglobus fulgidus* AF1676 | 42.5 | 71.8 | 245 | transcriptional regulator (Sir2 family) |
| 718 | 4218 | 658933 | 659424 | 492 | gp: SC5H1_34 | *Streptomyces coelicolor* A3(2) SC5H1.34 | 45.2 | 78.3 | 157 | hypothetical protein |
| 719 | 4219 | 659543 | 660538 | 996 | gp: CDU02617_1 | *Corynebacterium diphtheriae* irp1 | 31.1 | 62.2 | 357 | iron-regulated lipoprotein precursor |
| 720 | 4220 | 661120 | 660650 | 471 | pir: E70971 | *Mycobacterium tuberculosis* H37Rv Rv3366 spoU | 62.9 | 86.1 | 151 | rRNA methylase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 721 | 4221 | 661166 | 662017 | 852 | pir: C70970 | Mycobacterium tuberculosis H37Rv Rv3356c folD | 70.9 | 87.4 | 278 | methylenetetrahydrofolate dehydrogenase |
| 722 | 4222 | 662120 | 662374 | 255 | gp: MLCB1779_8 | Mycobacterium leprae MLCB1779.16c | 31.3 | 76.3 | 80 | hypothetical membrane protein |
| 723 | 4223 | 663761 | 662382 | 1380 | gp: SC66T3_18 | Streptomyces coelicolor A3(2) SC66T3.18c | 34.0 | 63.2 | 489 | hypothetical protein |
| 724 | 4224 | 665088 | 664126 | 963 | gp: AF052652_1 | Corynebacterium glutamicum metA | 99.5 | 99.5 | 379 | homoserine O-acetyltransferase |
| 725 | 4225 | 666313 | 665183 | 1131 | | | | | | |
| 726 | 4226 | 667770 | 666460 | 1311 | prf: 2317335A | Leptospira meyeri metY | 49.7 | 76.2 | 429 | O-acetylhomoserine sulfhydrylase |
| 727 | 4227 | 668264 | 670465 | 2202 | sp: CSTA_ECOLI | Escherichia coli K12 cstA | 53.9 | 78.4 | 690 | carbon starvation protein |
| 728 | 4228 | 670053 | 669445 | 609 | | | | | | |
| 729 | 4229 | 670472 | 670672 | 201 | sp: YJIX_ECOLI | Escherichia coli K12 yjiX | 40.0 | 66.0 | 50 | hypothetical protein |
| 730 | 4230 | 671653 | 671045 | 609 | | | | | | |
| 731 | 4231 | 671700 | 672653 | 954 | pir: C70539 | Mycobacterium tuberculosis H37Rv Rv1130 | 71.0 | 86.4 | 317 | hypothetical protein |
| 732 | 4232 | 672665 | 673576 | 912 | prf: 1902224A | Streptomyces hygroscopicus | 41.6 | 76.2 | 281 | carboxy phosphoenolpyruvate mutase |
| 733 | 4233 | 673608 | 674756 | 1149 | sp: CISY_MYCSM | Mycobacterium smegmatis ATCC 607 gltA | 56.1 | 81.3 | 380 | citrate synthase |
| 734 | 4234 | 673639 | 672710 | 930 | sp: YNEC_ECOLI | Escherichia coli K12 yneC | 34.0 | 62.3 | 53 | hypothetical protein |
| 735 | 4235 | 674990 | 674799 | 192 | | | | | | |
| 736 | 4236 | 675175 | 675846 | 672 | | | | | | |
| 737 | 4237 | 676122 | 675082 | 1041 | sp: MDH_METFE | Methanothermus fervidus V24S mdh | 37.6 | 67.5 | 338 | L-malate dehydrogenase |
| 738 | 4238 | 676937 | 676218 | 720 | prf: 2514353L | Bacillus stearothermophilus T-6 uxuR | 26.1 | 62.8 | 226 | regulatory protein |
| 739 | 4239 | 677748 | 677047 | 702 | sp: VIUB_VIBCH | Vibrio cholerae OGAWA 395 viuB | 25.4 | 54.2 | 284 | vibriobactin utilization protein |
| 740 | 4240 | 681027 | 680131 | 897 | | | | | | |
| 741 | 4241 | 681846 | 681040 | 807 | gp: AF176902_3 | Corynebacterium diphtheriae irp1D | 55.4 | 85.1 | 269 | ABC transporter ATP-binding protein |
| 742 | 4242 | 682904 | 681846 | 1059 | gp: AF176902_2 | Corynebacterium diphtheriae irp1C | 56.3 | 86.4 | 339 | ABC transporter |
| 743 | 4243 | 683866 | 682871 | 996 | gp: AF176902_1 | Corynebacterium diphtheriae irp1B | 63.0 | 88.2 | 330 | ABC transporter |
| 744 | 4244 | 684925 | 683876 | 1050 | gp: CDU02617_1 | Corynebacterium diphtheriae irp1 | 53.1 | 82.3 | 356 | iron-regulated lipoprotein precursor |
| 745 | 4245 | 685109 | 686380 | 1272 | prf: 2202262A | Streptomyces venezuelae cmlv | 32.2 | 69.6 | 395 | chloramphenicol resistance protein |
| 746 | 4246 | 686435 | 687346 | 912 | prf: 2222220B | Pseudomonas aeruginosa crc | 30.4 | 58.1 | 303 | catabolite repression control protein |
| 747 | 4247 | 687351 | 688007 | 657 | sp: YICG_HAEIN | Haemophilus influenzae Rd HI1240 | 56.2 | 85.8 | 219 | hypothetical protein |
| 748 | 4248 | 688141 | 688335 | 195 | | | | | | |
| 749 | 4249 | 689890 | 688916 | 975 | | | | | | |
| 750 | 4250 | 690696 | 689917 | 780 | gp: AF109162_3 | Corynebacterium diphtheriae hmuV | 45.1 | 73.8 | 244 | ferrichrome ABC transporter |
| 751 | 4251 | 691722 | 690706 | 1017 | pir: S54438 | Yersinia enterocolitica hemU | 38.7 | 69.1 | 346 | hemin permease |
| 752 | 4252 | 691882 | 692916 | 1035 | sp: SYW_ECOLI | Escherichia coli K12 trpS | 54.4 | 79.8 | 331 | tryptophanyl-tRNA synthetase |
| 753 | 4253 | 693028 | 694110 | 1083 | sp: YHJD_ECOLI | Escherichia coli K12 yhjD | 37.1 | 72.3 | 278 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 754 | 4254 | 694172 | 695074 | 903 | sp: DACD_SALTY | *Salmonella typhimurium* LT2 dacD | 30.9 | 57.5 | 301 | penicillin-binding protein 6B precursor |
| 755 | 4255 | 696213 | 695077 | 1137 | | | 34.1 | 70.7 | 417 | hypothetical protein |
| 756 | 4256 | 697995 | 696769 | 1227 | pir: F70842 | *Mycobacterium tuberculosis* H37Rv Rv3311 | | | | |
| 757 | 4257 | 698922 | 698065 | 858 | gp: SC6G10_8 | *Streptomyces coelicolor* A3(2) SC6G10.08c | 29.4 | 52.6 | 323 | hypothetical protein |
| 758 | 4258 | 699072 | 699266 | 195 | | | | | | |
| 759 | 4259 | 699272 | 698922 | 351 | | | | | | |
| 760 | 4260 | 699281 | 699913 | 633 | sp: UPP_LACLA | *Lactococcus lactis* upp | 46.4 | 72.3 | 209 | uracil phosphoribosyltransferase |
| 761 | 4261 | 699998 | 700381 | 384 | gp: SC1A2_11 | *Streptomyces coelicolor* A3(2) SC1A2.11 | 41.6 | 66.2 | 77 | bacterial regulatory protein, lacI family |
| 762 | 4262 | 702081 | 703262 | 1182 | pir: H70841 | *Mycobacterium tuberculosis* H37Rv Rv3305c amiA | 51.4 | 80.5 | 385 | N-acyl-L-amino acid amidohydrolase or peptidase |
| 763 | 4263 | 702108 | 700384 | 1725 | sp: MANB_MYCPI | *Mycoplasma pirum* BER manB | 22.1 | 53.8 | 561 | phosphomannomutase |
| 764 | 4264 | 703405 | 704811 | 1407 | sp: DLDH_HALVO | *Halobacterium volcanii* ATCC 29605 lpd | 31.6 | 65.0 | 468 | dihydrolipoamide dehydrogenase |
| 765 | 4265 | 705211 | 708630 | 3420 | prf: 2415454A | *Corynebacterium glutamicum* strain21253 pyc | 100.0 | 100.0 | 1140 | pyruvate carboxylase |
| 766 | 4266 | 708839 | 709708 | 870 | sp: YD24_MYCTU | *Mycobacterium tuberculosis* H37Rv Rv1324 | 26.2 | 60.1 | 263 | hypothetical protein |
| 767 | 4267 | 709793 | 710278 | 486 | gp: SCF11_30 | *Streptomyces coelicolor* A3(2) SCF11.30 | 30.7 | 66.9 | 127 | hypothetical protein |
| 768 | 4268 | 711605 | 710520 | 1086 | pir: B69760 | *Bacillus subtilis* 168 yciC | 44.6 | 69.0 | 381 | hypothetical protein |
| 769 | 4269 | 711724 | 712647 | 924 | sp: TRXB_BACSU | *Bacillus subtilis* IS58 trxB | 24.6 | 59.3 | 305 | thioredoxin reductase |
| 770 | 4270 | 712738 | 714231 | 1494 | sp: PRPD_SALTY | *Salmonella typhimurium* LT2 prpD | 24.0 | 49.5 | 521 | PrpD protein for propionate catabolism |
| 771 | 4271 | 714258 | 715145 | 888 | prf: 1902224A | *Streptomyces hygroscopicus* | 42.5 | 74.5 | 278 | carboxy phosphoenolpyruvate mutase |
| 772 | 4272 | 714757 | 714380 | 378 | PIR: E72779 | *Aeropyrum pernix* K1 APE0223 | 39.0 | 47.0 | 96 | hypothetical protein |
| 773 | 4273 | 715102 | 716283 | 1182 | sp: CISY_MYCSM | *Mycobacterium smegmatis* ATCC 607 gltA | 54.6 | 78.9 | 383 | citrate synthase |
| 774 | 4274 | 716660 | 716286 | 375 | | | | | | |
| 775 | 4275 | 718009 | 716687 | 1323 | pir: H70539 | *Mycobacterium tuberculosis* H37Rv Rv1129c | 40.8 | 72.6 | 456 | hypothetical protein |
| 776 | 4276 | 718105 | 718350 | 246 | | | | | | |
| 777 | 4277 | 718658 | 720016 | 1359 | | | | | | |
| 778 | 4278 | 721449 | 720547 | 903 | sp: THTR_CORGL | *Corynebacterium glutamicum* ATCC 13032 thtR | 100.0 | 100.0 | 225 | thiosulfate sulfurtransferase |
| 779 | 4279 | 721777 | 722841 | 1065 | gp: CJ11168X1_62 | *Campylobacter jejuni* Cj0069 | 61.1 | 79.8 | 352 | hypothetical protein |
| 780 | 4280 | 723338 | 722925 | 414 | gp: MLCB4_16 | *Mycobacterium leprae* MLCB4.27c | 51.1 | 76.7 | 133 | hypothetical protein |
| 781 | 4281 | 723412 | 725559 | 2148 | pir: G70539 | *Mycobacterium tuberculosis* H37Rv Rv1565c | 35.1 | 63.4 | 718 | hypothetical membrane protein |
| 782 | 4282 | 726462 | 725872 | 591 | sp: YCEF_ECOLI | *Escherichia coli* K12 yceF | 31.8 | 66.2 | 192 | hypothetical protein |
| 783 | 4283 | 726715 | 726470 | 246 | prf: 2323363CF | *Mycobacterium leprae* B1308-C3-211 | 33.3 | 69.8 | 63 | hypothetical protein |
| 784 | 4284 | 728352 | 726742 | 1611 | gp: AB018531_2 | *Corynebacterium glutamicum* AJ11060 dtsR2 | 99.8 | 100.0 | 537 | detergent sensitivity rescuer or carboxyl transferase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 785 | 4285 | 730324 | 728696 | 1629 | pir: JC4991 | Corynebacterium glutamicum AJ11060 dtsR1 | 99.6 | 100.0 | 543 | detergent sensitivity rescuer or carboxyl transferase |
| 786 | 4286 | 730436 | 731299 | 864 | sp: BIRA_ECOLI | Escherichia coli K12 birA | 28.7 | 61.8 | 293 | bifunctional protein (biotin synthesis repressor and biotin acetyl-CoA carboxylase ligase) |
| 787 | 4287 | 731312 | 731797 | 486 | pir: G70979 | Mycobacterium tuberculosis H37Rv Rv3278c | 23.0 | 58.8 | 165 | hypothetical membrane protein |
| 788 | 4288 | 731857 | 733017 | 1161 | sp: PURK_CORAM | Corynebacterium ammoniagenes ATCC 6872 purK | 69.0 | 83.8 | 394 | 5′-phosphoribosyl-5-amino-4-imidasol carboxylase |
| 789 | 4289 | 733072 | 734943 | 1872 | sp: KUP_ECOLI | Escherichia coli K12 kup | 41.1 | 73.6 | 628 | K+-uptake protein |
| 790 | 4290 | 733797 | 733183 | 615 | | | | | | |
| 791 | 4291 | 734984 | 735340 | 357 | | | | | | |
| 792 | 4292 | 735402 | 735896 | 495 | sp: PUR6_CORAM | Corynebacterium ammoniagenes ATCC 6872 purE | 85.7 | 93.2 | 147 | 5′-phosphoribosyl-5-amino-4-imidasol carboxylase |
| 793 | 4293 | 735899 | 736351 | 453 | gp: APU33059_5 | Actinosynnema pretiosum | 36.2 | 60.5 | 152 | hypothetical protein |
| 794 | 4294 | 736413 | 737204 | 792 | gp: SCF43A_36 | Streptomyces coelicolor A3(2) SCF43A.36 | 42.8 | 70.6 | 255 | hypothetical protein |
| 795 | 4295 | 738529 | 737216 | 1314 | sp: NTAA_CHEHE | Chelatobacter heintzii ATCC 29600 ntaA | 43.2 | 73.0 | 426 | nitrilotriacetate monooxygenase |
| 796 | 4296 | 740172 | 738673 | 1500 | pir: A69426 | Archaeoglobus fulgidus | 23.4 | 52.5 | 303 | transposase (ISA0963-5) |
| 797 | 4297 | 741016 | 740228 | 789 | sp: DHG2_BACME | Bacillus megaterium IAM 1030 gdhII | 31.3 | 64.8 | 256 | glucose 1-dehydrogenase |
| 798 | 4298 | 741397 | 741765 | 369 | pir: A72258 | Thermotoga maritima MSB8 TM1408 | 29.2 | 68.8 | 96 | hypothetical membrane protein |
| 799 | 4299 | 741854 | 742195 | 342 | sp: YWJB_BACSU | Bacillus subtilis 168 ywjB | 28.6 | 66.3 | 175 | hypothetical protein |
| 800 | 4300 | 742384 | 741818 | 567 | gp: SCJ9A_21 | Streptomyces coelicolor A3(2) SCJ9A.21 | 35.9 | 76.8 | 142 | hypothetical protein |
| 801 | 4301 | 742409 | 742828 | 420 | | | | | | |
| 802 | 4302 | 743052 | 742831 | 222 | | | | | | |
| 803 | 4303 | 743900 | 743067 | 834 | prf: 2406355C | Thermococcus litoralis malG | 42.4 | 75.3 | 271 | trehalose/maltose-binding protein |
| 804 | 4304 | 744931 | 743900 | 1032 | prf: 2406355B | Thermococcus litoralis malF | 37.3 | 70.3 | 306 | trehalose/maltose-binding protein |
| 805 | 4305 | 745513 | 745046 | 468 | | | | | | |
| 806 | 4306 | 746893 | 745622 | 1272 | prf: 2406355A | Thermococcus litoralis malE | 30.9 | 62.4 | 417 | trehalose/maltose-binding protein |
| 807 | 4307 | 748020 | 748442 | 423 | | | | | | |
| 808 | 4308 | 748026 | 747031 | 996 | prf: 2308356A | Streptomyces reticuli msiK | 57.2 | 73.9 | 332 | ABC transporter ATP-binding protein (ABC-type sugar transport protein) or celloblose/maltose transport protein |
| 809 | 4309 | 748446 | 748814 | 369 | | | | | | |
| 810 | 4310 | 753685 | 748886 | 4800 | pir: B75633 | Deinococcus radiodurans R1 DRB0135 | 25.1 | 49.9 | 1783 | RNA helicase |
| 811 | 4311 | 757063 | 757434 | 372 | | | | | | |
| 812 | 4312 | 757395 | 753697 | 3699 | | | | | | |
| 813 | 4313 | 758262 | 757630 | 633 | pir: E70978 | Mycobacterium tuberculosis H37Rv Rv3268 | 31.7 | 59.2 | 240 | hypothetical protein |
| 814 | 4314 | 760796 | 758364 | 2433 | pir: C71929 | Helicobacter pylori J99 jhp0462 | 30.0 | 62.5 | 720 | hypothetical protein |
| 815 | 4315 | 762468 | 760906 | 1563 | sp: UVRD_ECOLI | Escherichia coli K12 uvrD | 20.7 | 41.1 | 701 | DNA helicase II |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 816 | 4316 | 762497 | 762853 | 357 | | | | | | |
| 817 | 4317 | 762730 | 763122 | 393 | | | | | | |
| 818 | 4318 | 762977 | 762582 | 396 | | | | | | |
| 819 | 4319 | 768191 | 767367 | 825 | | | | | | |
| 820 | 4320 | 769443 | 763237 | 6207 | pir: T36671 | *Streptomyces coelicolor* SCH5.13 | 22.4 | 45.8 | 2033 | RNA helicase |
| 821 | 4321 | 774142 | 769547 | 4596 | pir: T08313 | *Halobacterium* sp. NRC-1 plasmid pNRC100 H1130 | 24.4 | 53.2 | 698 | hypothetical protein |
| 822 | 4322 | 777035 | 774150 | 2886 | sp: HEPA_ECOLI | *Escherichia coli* K12 hepA | 23.1 | 48.6 | 873 | RNA polymerase associated protein (ATP-dependent helicase) |
| 823 | 4323 | 778711 | 777158 | 1554 | pir: D70978 | *Mycobacterium tuberculosis* H37Rv Rv3267 | 45.5 | 71.4 | 527 | hypothetical protein |
| 824 | 4324 | 779014 | 779910 | 897 | gp: AF187550_1 | *Mycobacterium smegmatis* mc2155 wbbL | 56.4 | 77.9 | 289 | dTDP-Rha: a-D-GlcNAc-diphosphoryl polyprenol, a-3-L-rhamnosyl transferase |
| 825 | 4325 | 780128 | 781171 | 1044 | sp: MPG1_YEAST | *Saccharomyces cerevisiae* YDL055C MPG1 | 29.8 | 66.9 | 353 | mannose-1-phosphate guanylyltransferase |
| 826 | 4326 | 781468 | 781875 | 408 | gp: AF164439_1 | *Mycobacterium smegmatis* whmD | 73.4 | 81.9 | 94 | regulatory protein |
| 827 | 4327 | 782617 | 782162 | 456 | pir: D70847 | *Mycobacterium tuberculosis* H37Rv Rv3259 | 48.9 | 74.8 | 139 | hypothetical protein |
| 828 | 4328 | 782712 | 783101 | 390 | gp: SCE34_11 | *Streptomyces coelicolor* A3(2) SCE34.11c | 51.5 | 71.3 | 136 | hypothetical protein |
| 829 | 4329 | 783184 | 784557 | 1374 | sp: MANB_SALMO | *Salmonella montevideo* M40 manB | 38.0 | 66.3 | 460 | phosphomannomutase |
| 830 | 4330 | 784635 | 785639 | 1005 | pir: B70594 | *Mycobacterium tuberculosis* H37Rv Rv3256c | 31.2 | 56.3 | 327 | hypothetical protein |
| 831 | 4331 | 785643 | 786824 | 1182 | sp: MANA_ECOLI | *Escherichia coli* K12 manA | 36.9 | 66.2 | 420 | mannose-6-phosphate isomerase |
| 832 | 4332 | 786896 | 787045 | 150 | | | | | | |
| 833 | 4333 | 787624 | 787983 | 360 | | | | | | |
| 834 | 4334 | 787733 | 787170 | 564 | prf: 1804279K | *Enterococcus faecalis* plasmid pCF10 prgC | 35.6 | 57.8 | 180 | pheromone-responsive protein |
| 835 | 4335 | 788196 | 788546 | 351 | | | | | | |
| 836 | 4336 | 788672 | 790093 | 1422 | sp: SAHH_TRIVA | *Trichomonas vaginalis* WAA38 | 59.0 | 83.0 | 476 | S-adenosyl-L-homocysteine hydrolase |
| 837 | 4337 | 789426 | 788719 | 708 | | | | | | |
| 838 | 4338 | 789721 | 789002 | 720 | | | | | | |
| 839 | 4339 | 790096 | 790704 | 609 | sp: KTHY_ARCFU | *Archaeoglobus fulgidus* VC-16 AF0061 | 25.8 | 56.0 | 209 | thymidylate kinase |
| 840 | 4340 | 790732 | 791409 | 678 | prf: 2214304A | *Mycobacterium tuberculosis* H37Rv Rv3246c mtrA | 73.7 | 90.6 | 224 | two-component system response regulator |
| 841 | 4341 | 791421 | 790738 | 684 | | | | | | |
| 842 | 4342 | 791512 | 793008 | 1497 | prf: 2214304B | *Mycobacterium tuberculosis* H37Rv Rv3245c mtrB | 53.1 | 78.9 | 484 | two-component system sensor histidine kinase |
| 843 | 4343 | 793008 | 794711 | 1704 | pir: F70592 | *Mycobacterium tuberculosis* H37Rv Rv3244c lpqB | 29.6 | 65.6 | 595 | lipoprotein |
| 844 | 4344 | 794714 | 795301 | 588 | pir: D70592 | *Mycobacterium tuberculosis* H37Rv Rv3242c | 38.0 | 72.8 | 213 | hypothetical protein |
| 845 | 4345 | 795447 | 795292 | 156 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 846 | 4346 | 795448 | 796110 | 663 | sp: RR30_SPIOL | *Spinacia oleracea* CV rps22 | 34.5 | 61.6 | 203 | 30S ribosomal protein or chloroplast precursor |
| 847 | 4347 | 796250 | 798784 | 2535 | gsp: R74093 | *Brevibacterium flavum* (*Corynebacterium glutamicum*) MJ-233 secA | 99.1 | 99.6 | 845 | preprotein translocase SecA subunit |
| 848 | 4348 | 799020 | 799691 | 672 | | | | | | |
| 849 | 4349 | 799697 | 800200 | 504 | pir: A70591 | *Mycobacterium tuberculosis* H37Rv Rv3231c | 47.1 | 78.8 | 170 | hypothetical protein |
| 850 | 4350 | 801194 | 800208 | 987 | pir: F70590 | *Mycobacterium tuberculosis* H37Rv Rv3228 | 64.6 | 82.9 | 322 | hypothetical protein |
| 851 | 4351 | 802602 | 801190 | 1413 | gp: AF114233_1 | *Corynebacterium glutamicum* ASO19 aroA | 99.0 | 99.0 | 461 | 5-enolpyruvylshikimate 3-phosphate synthase |
| 852 | 4352 | 802649 | 803128 | 480 | pir: D70590 | *Mycobacterium tuberculosis* H37Rv Rv3226c | 38.3 | 63.9 | 180 | hypothetical protein |
| 853 | 4353 | 802687 | 802565 | 123 | GP: AF114233_1 | *Corynebacterium glutamicum* | 100.0 | 100.0 | 23 | 5-enolpyruvylshikimate 3-phosphate synthase |
| 854 | 4354 | 804240 | 803131 | 1110 | pir: A70506 | *Mycobacterium tuberculosis* H37Rv Rv0336 | 21.6 | 42.4 | 380 | hypothetical protein |
| 855 | 4355 | 804408 | 805025 | 618 | pfl: 2515333D | *Mycobacterium tuberculosis* sigH | 61.2 | 87.2 | 188 | RNA polymerase sigma factor |
| 856 | 4356 | 805792 | 805535 | 258 | pir: D70596 | *Mycobacterium tuberculosis* H37Rv Rv3219 whiB1 | 78.6 | 96.4 | 84 | regulatory protein |
| 857 | 4357 | 806318 | 806737 | 420 | pir: B70596 | *Mycobacterium tuberculosis* H37Rv Rv3217c | 33.3 | 65.1 | 129 | hypothetical protein |
| 858 | 4358 | 807939 | 806740 | 1200 | pir: E70595 | *Mycobacterium tuberculosis* H37Rv Rv3212 | 29.6 | 62.2 | 415 | hypothetical protein |
| 859 | 4359 | 809217 | 807946 | 1272 | sp: DEAD_KLEPN | *Klebsiella pneumoniae* CG43 deaD | 37.3 | 64.0 | 458 | DEAD box ATP-dependent RNA helicase |
| 860 | 4360 | 809286 | 809510 | 225 | | | | | | |
| 861 | 4361 | 809549 | 810394 | 846 | pir: H70594 | *Mycobacterium tuberculosis* H37Rv Rv3207c | 46.4 | 69.8 | 291 | hypothetical protein |
| 862 | 4362 | 810405 | 811163 | 759 | pir: F70594 | *Mycobacterium tuberculosis* H37Rv Rv3205c | 37.0 | 65.9 | 249 | hypothetical protein |
| 863 | 4363 | 811170 | 814217 | 3048 | pir: G70951 | *Mycobacterium tuberculosis* H37Rv Rv3201c | 23.9 | 48.9 | 1155 | ATP-dependent DNA helicase |
| 864 | 4364 | 812165 | 811386 | 780 | pir: G70951 | *Mycobacterium tuberculosis* H37Rv Rv3201c | 41.4 | 65.7 | 1126 | ATP-dependent DNA helicase |
| 865 | 4365 | 814204 | 817422 | 3219 | | | | | | |
| 866 | 4366 | 815541 | 814210 | 1332 | sp: Y13B_METJA | *Methanococcus jannaschii* JAL-1 MJ0138.1. | 26.2 | 64.2 | 302 | potassium channel |
| 867 | 4367 | 817519 | 818523 | 1005 | pir: E70951 | *Mycobacterium tuberculosis* H37Rv Rv3199c | 30.4 | 58.3 | 230 | hypothetical protein |
| 868 | 4368 | 818523 | 819236 | 714 | sp: UVRD_ECOLI | *Escherichia coli* K12 uvrD | 32.6 | 58.8 | 660 | DNA helicase II |
| 869 | 4369 | 819254 | 821287 | 2034 | | | | | | |
| 870 | 4370 | 822079 | 822669 | 591 | | | | | | |
| 871 | 4371 | 822105 | 821290 | 816 | pir: B70951 | *Mycobacterium tuberculosis* H37Rv Rv3196 | 26.8 | 49.3 | 280 | hypothetical protein |
| 872 | 4372 | 822789 | 823391 | 603 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 873 | 4373 | 824125 | 822680 | 1446 | pir: A70951 | Mycobacterium tuberculosis H37Rv Rv3195 | 42.8 | 76.4 | 474 | hypothetical protein |
| 874 | 4374 | 824190 | 825239 | 1050 | pir: H70950 | Mycobacterium tuberculosis H37Rv Rv3194 | 43.4 | 74.9 | 350 | hypothetical protein |
| 875 | 4375 | 825916 | 825242 | 675 | | | | | | |
| 876 | 4376 | 826517 | 825996 | 522 | | | | | | |
| 877 | 4377 | 826616 | 829570 | 2955 | pir: G70950 | Mycobacterium tuberculosis H37Rv Rv3193c | 47.2 | 73.5 | 1023 | hypothetical protein |
| 878 | 4378 | 830985 | 829627 | 1359 | gp: AE001938_5 | Deinococcus radiodurans DR0840 | 34.3 | 57.7 | 463 | regulatory protein |
| 879 | 4379 | 831021 | 831971 | 951 | sp: ER1_HEVBR | Hevea brasiliensis laticifer er1 | 67.4 | 89.0 | 301 | ethylene-inducible protein |
| 880 | 4380 | 831922 | 831578 | 345 | PIR: F72782 | Aeropyrum pernix K1 APE0247 | 49.0 | 53.0 | 81 | hypothetical protein |
| 881 | 4381 | 831971 | 832570 | 600 | sp: YAAE_BACSU | Bacillus subtilis 168 yaaE | 40.8 | 73.6 | 201 | hypothetical protein |
| 882 | 4382 | 833157 | 832795 | 363 | | | | | | |
| 883 | 4383 | 833572 | 834633 | 1062 | pir: TRYXB4 | Lysobacter enzymogenes ATCC 29487 | 26.7 | 44.4 | 408 | alpha-lytic proteinase precursor |
| 884 | 4384 | 834888 | 835388 | 501 | | | | | | |
| 885 | 4385 | 835253 | 835837 | 585 | pir: S03722 | Neurospora intermedia LaBelle-1b mitochondrion plasmid | 25.0 | 51.4 | 208 | DNA-directed DNA polymerase |
| 886 | 4386 | 837312 | 838892 | 1581 | sp: CSP1_CORGL | Corynebacterium glutamicum (Brevibacterium flavum) ATCC 17965 csp1 | 27.0 | 51.5 | 363 | major secreted protein PS1 protein precursor |
| 887 | 4387 | 838925 | 839353 | 429 | | | | | | |
| 888 | 4388 | 839630 | 840139 | 510 | | | | | | |
| 889 | 4389 | 840431 | 840210 | 222 | | | | | | |
| 890 | 4390 | 840745 | 840437 | 309 | | | | | | |
| 891 | 4391 | 842296 | 841517 | 780 | prf: 2207273H | Streptomyces alboniger pur3 | 51.8 | 74.9 | 255 | monophosphatase |
| 892 | 4392 | 843124 | 842306 | 819 | gp: U70376_9 | Streptomyces flavopersicus spcA | 33.7 | 59.3 | 243 | myo-inositol monophosphatase |
| 893 | 4393 | 843257 | 844360 | 1104 | sp: RF2_STRCO | Streptomyces coelicolor A3(2) prfB | 68.0 | 88.6 | 359 | peptide chain release factor 2 |
| 894 | 4394 | 844495 | 845181 | 687 | pir: E70919 | Mycobacterium tuberculosis H37Rv Rv3102c ftsE | 70.4 | 91.2 | 226 | cell division ATP-binding protein |
| 895 | 4395 | 845105 | 844842 | 264 | PIR: G72510 | Aeropyrum pernix K1 APE2061 | 43.0 | 54.0 | 72 | hypothetical protein |
| 896 | 4396 | 845198 | 846097 | 900 | pir: D70919 | Mycobacterium tuberculosis H37Rv Rv3101c ftsX | 40.5 | 74.8 | 301 | cell division protein |
| 897 | 4397 | 846137 | 846628 | 492 | sp: SMPB_ECOLI | Escherichia coli K12 smpB | 43.5 | 75.9 | 145 | small protein B (SSRA-binding protein) |
| 898 | 4398 | 846632 | 846982 | 351 | sp: YEAO_ECOLI | Escherichia coli K12 yeaO | 44.0 | 73.3 | 116 | hypothetical protein |
| 899 | 4399 | 846805 | 846269 | 537 | | | | | | |
| 900 | 4400 | 847727 | 848026 | 300 | | | | | | |
| 901 | 4401 | 848122 | 847718 | 405 | | | | | | |
| 902 | 4402 | 849323 | 848499 | 825 | sp: VIUB_VIBCH | Vibrio cholerae OGAWA 395 viuB | 26.8 | 52.9 | 272 | vibriobactin utilization protein |
| 903 | 4403 | 850243 | 849326 | 918 | prf: 2510361A | Staphylococcus aureus sirA | 29.5 | 58.3 | 319 | Fe-regulated protein |
| 904 | 4404 | 850999 | 850412 | 588 | gp: MLCB1243_5 | Mycobacterium leprae MLCB1243.07 | 36.1 | 71.2 | 191 | hypothetical membrane protein |
| 905 | 4405 | 851351 | 852364 | 1014 | sp: FATB_VIBAN | Vibrio anguillarum 775 fatB | 27.7 | 61.5 | 325 | ferric anguibactin-binding protein precursor |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 906 | 4406 | 852618 | 853616 | 999 | pir: B69763 | Bacillus subtilis 168 yclN | 39.3 | 80.8 | 313 | ferrichrome ABC transporter (permease) |
| 907 | 4407 | 853783 | 854724 | 942 | pir: C69763 | Bacillus subtilis 168 yclO | 35.6 | 76.0 | 312 | ferrichrome ABC transporter (permease) |
| 908 | 4408 | 854724 | 855476 | 753 | pir: D69763 | Bacillus subtilis 168 yclP | 48.4 | 82.0 | 250 | ferrichrome ABC transporter (ATP-binding protein) |
| 909 | 4409 | 860224 | 860078 | 147 | PIR: F81737 | Chlamydia muridarum Nigg TC0129 | 66.0 | 72.0 | 48 | hypothetical protein |
| 910 | 4410 | 860745 | 860473 | 273 | GSP: Y35814 | Chlamydia pneumoniae | 61.0 | 66.0 | 84 | hypothetical protein |
| 911 | 4411 | 861544 | 862752 | 1209 | pir: S66270 | Rattus norvegicus (Rat) | 33.5 | 64.9 | 442 | kynurenine aminotransferase/glutamine transaminase K |
| 912 | 4412 | 863391 | 862753 | 639 | | | | | | |
| 913 | 4413 | 865066 | 863396 | 1671 | sp: RA25_YEAST | Saccharomyces cerevisiae S288C YIL143C RAD25 | 30.7 | 62.3 | 613 | DNA repair helicase |
| 914 | 4414 | 867317 | 865119 | 2199 | pir: F70815 | Mycobacterium tuberculosis H37Rv Rv0862c | 36.1 | 65.2 | 764 | hypothetical protein |
| 915 | 4415 | 867353 | 867571 | 219 | pir: G70815 | Mycobacterium tuberculosis H37Rv Rv0863 | 44.0 | 62.0 | 57 | hypothetical protein |
| 916 | 4416 | 867788 | 868630 | 843 | | | | | | |
| 917 | 4417 | 868399 | 867803 | 597 | prf: 2420502A | Micrococcus luteus rpf | 39.4 | 64.7 | 198 | resuscitation-promoting factor |
| 918 | 4418 | 868938 | 869318 | 381 | prf: 2320271A | Lactococcus lactis cspB | 42.6 | 75.4 | 61 | cold shock protein |
| 919 | 4419 | 869903 | 869379 | 525 | gp: MLCB57_11 | Mycobacterium leprae MLCB57.27c | 28.3 | 58.5 | 159 | hypothetical protein |
| 920 | 4420 | 870691 | 869918 | 774 | gp: AE001874_1 | Deinococcus radiodurans DR0112 | 41.8 | 67.8 | 273 | glutamine cyclotransferase |
| 921 | 4421 | 871419 | 870721 | 699 | | | | | | |
| 922 | 4422 | 871523 | 871660 | 138 | | | | | | |
| 923 | 4423 | 871738 | 873210 | 1473 | gp: SC6C5_9 | Streptomyces coelicolor A3(2) SC6C5.09 | 43.6 | 79.3 | 477 | permease |
| 924 | 4424 | 872927 | 872016 | 912 | | | | | | |
| 925 | 4425 | 873213 | 874040 | 828 | sp: TSNR_STRAZ | Streptomyces azureus tsnR | 27.9 | 51.7 | 319 | rRNA(adenosine-2′-O)-methyltransferase |
| 926 | 4426 | 874944 | 874069 | 876 | sp: YZI1_MYCTU | Mycobacterium tuberculosis H37Rv Rv0883c | 32.6 | 55.1 | 316 | hypothetical protein |
| 927 | 4427 | 875883 | 874951 | 933 | | | | | | |
| 928 | 4428 | 877112 | 875985 | 1128 | pir: S71439 | Bacillus circulans ATCC 21783 | 21.9 | 52.9 | 374 | phosphoserine transaminase |
| 929 | 4429 | 881114 | 879642 | 1473 | sp: ACCD_ECOLI | Escherichia coli K12 accD | 36.0 | 69.5 | 236 | acetyl-coenzyme A carboxylase carboxy transferase subunit beta |
| 930 | 4430 | 881647 | 881985 | 339 | gp: SCI8_8 | Streptomyces coelicolor A3(2) SCI8.08c | 51.5 | 80.6 | 103 | hypothetical protein |
| 931 | 4431 | 881995 | 883647 | 1653 | pir: JC2382 | Pseudomonas fluorescens | 26.4 | 58.1 | 549 | sodium/proline symporter |
| 932 | 4432 | 883726 | 884541 | 816 | | | | | | |
| 933 | 4433 | 885388 | 884549 | 840 | pir: A70657 | Mycobacterium tuberculosis H37Rv Rv2525c | 49.0 | 77.4 | 243 | hypothetical protein |
| 934 | 4434 | 885672 | 894578 | 8907 | pir: S55505 | Corynebacterium ammoniagenes fas | 63.1 | 83.4 | 3026 | fatty-acid synthase |
| 935 | 4435 | 894703 | 895191 | 489 | | | | | | |
| 936 | 4436 | 895408 | 895593 | 186 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 937 | 4437 | 896642 | 895596 | 1047 | prf: 2317335B | *Leptospira meyeri* metX | 29.0 | 59.7 | 335 | homoserine O-acetyltransferase |
| 938 | 4438 | 897144 | 896719 | 426 | | | | | | |
| 939 | 4439 | 897423 | 897689 | 267 | | | | | | |
| 940 | 4440 | 897963 | 897727 | 237 | gp: AE002044_8 | *Deinococcus radiodurans* DR2085 | 43.6 | 72.6 | 62 | glutaredoxin |
| 941 | 4441 | 898434 | 897979 | 456 | prf: 2408256A | *Mycobacterium avium* folA | 38.0 | 62.0 | 171 | dihydrofolate reductase |
| 942 | 4442 | 899231 | 898434 | 798 | sp: TYSY_ECOLI | *Escherichia coli* K12 thyA | 64.8 | 88.9 | 261 | thymidylate synthase |
| 943 | 4443 | 900008 | 899253 | 756 | sp: CYSQ_ECOLI | *Escherichia coli* K12 cysQ | 32.2 | 56.4 | 202 | ammonium transporter |
| 944 | 4444 | 900043 | 904602 | 4560 | gp: SC7C7_16 | *Streptomyces coelicolor* A3(2) SC7C7.16c | 47.4 | 68.1 | 1715 | ATP dependent DNA helicase |
| 945 | 4445 | 904615 | 905382 | 768 | sp: FPG_SYNEN | *Synechococcus elongatus naegeli* mutM | 29.2 | 51.0 | 298 | formamidopyrimidine-DNA glycosidase |
| 946 | 4446 | 905389 | 905796 | 408 | pir: F70816 | *Mycobacterium tuberculosis* H37Rv Rv0870c | 55.5 | 86.7 | 128 | hypothetical protein |
| 947 | 4447 | 906391 | 905792 | 600 | sp: APL_LACLA | *Lactococcus lactis* MG1363 apl | 38.8 | 71.9 | 196 | alkaline phosphatase |
| 948 | 4448 | 907731 | 906559 | 1173 | pir: T36776 | *Streptomyces coelicolor* A3(2) SC128.06c | 33.8 | 67.0 | 403 | integral membrane transporter |
| 949 | 4449 | 908612 | 909328 | 717 | pir: NUFC | *Escherichia coli* JM101 pgi | 52.4 | 77.0 | 557 | glucose-6-phosphate isomerase |
| 950 | 4450 | 909378 | 907759 | 1620 | pir: G70506 | *Mycobacterium tuberculosis* H37Rv Rv0336 | 24.6 | 52.3 | 195 | hypothetical protein |
| 951 | 4451 | 910696 | 909521 | 1176 | | | | | | |
| 952 | 4452 | 910843 | 911223 | 381 | sp: YT26_MYCTU | *Mycobacterium tuberculosis* H37Rv Rv0948c | 59.0 | 85.9 | 78 | hypothetical protein |
| 953 | 4453 | 911163 | 910855 | 309 | | | | | | |
| 954 | 4454 | 911226 | 913514 | 2289 | sp: PCRA_BACST | *Bacillus stearothermophilus* NCA 1503 pcrA | 46.1 | 73.1 | 763 | ATP-dependent helicase |
| 955 | 4455 | 915699 | 913477 | 2223 | gp: SCE25_30 | *Streptomyces coelicolor* A3(2) SCE25.30 | 21.8 | 48.6 | 885 | ABC transporter |
| 956 | 4456 | 916364 | 915699 | 666 | prf: 2420410P | *Bacillus subtilis* 168 yvrO | 43.8 | 71.4 | 217 | ABC transporter |
| 957 | 4457 | 916874 | 916368 | 507 | | | | | | |
| 958 | 4458 | 917680 | 916970 | 711 | pir: D70716 | *Mycobacterium tuberculosis* H37Rv Rv0950c | 43.6 | 73.3 | 236 | peptidase |
| 959 | 4459 | 917928 | 919352 | 1425 | sp: YT19_MYCTU | *Mycobacterium tuberculosis* H37Rv Rv0955 | 31.1 | 60.8 | 434 | hypothetical protein |
| 960 | 4460 | 918054 | 917827 | 228 | | | | | | |
| 961 | 4461 | 919330 | 919956 | 627 | gp: AB003159_2 | *Corynebacterium ammoniagenes* purN | 64.6 | 86.2 | 189 | 5'-phosphoribosylglycinamide formyltransferase |
| 962 | 4462 | 919967 | 921526 | 1560 | gp: AB003159_3 | *Corynebacterium ammoniagenes* purH | 74.5 | 87.8 | 525 | 5'-phosphoribosyl-5-aminoimidazole-4-carboxamide formyltransferase |
| 963 | 4463 | 921594 | 922412 | 819 | gp: CGL133719_3 | *Corynebacterium glutamicum* ATCC 13032 citE | 100.0 | 100.0 | 217 | citrate lyase (subunit) |
| 964 | 4464 | 923061 | 922396 | 666 | gp: CGL133719_2 | *Corynebacterium glutamicum* ATCC 13032 amtR | 100.0 | 100.0 | 222 | repressor of the high-affinity (methyl) ammonium uptake system |
| 965 | 4465 | 923464 | 923138 | 327 | gp: CGL133719_1 | *Corynebacterium glutamicum* ATCC 13032 yjcC | 100.0 | 100.0 | 109 | hypothetical protein |
| 966 | 4466 | 923661 | 923981 | 321 | | | | | | |
| 967 | 4467 | 924407 | 924159 | 249 | sp: RR18_CYAPA | *Cyanophora paradoxa* rps18 | 52.2 | 76.1 | 67 | 30S ribosomal protein S18 |
| 968 | 4468 | 924727 | 924425 | 303 | sp: RS14_ECOLI | *Escherichia coli* K12 rpsN | 54.0 | 80.0 | 100 | 30S ribosomal protein S14 |
| 969 | 4469 | 924895 | 924734 | 162 | sp: RL33_ECOLI | *Escherichia coli* K12 rpmG | 55.1 | 83.7 | 49 | 50S ribosomal protein L33 |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 970 | 4470 | 925134 | 924901 | 234 | pir: R5EC28 | *Escherichia coli* K12 rpmB | 52.0 | 81.8 | 77 | 50S ribosomal protein L28 |
| 971 | 4471 | 926935 | 925325 | 1611 | pir: B70033 | *Bacillus subtilis* 168 yvdB | 34.4 | 71.1 | 529 | transporter (sulfate transporter) |
| 972 | 4472 | 927242 | 926931 | 312 | prf: 2420312A | *Staphylococcus aureus* zntR | 37.5 | 77.5 | 80 | Zn/Co transport repressor |
| 973 | 4473 | 927474 | 927737 | 264 | sp: RL31_HAEDU | *Haemophilus ducreyi* rpmE | 37.2 | 65.4 | 78 | 50S ribosomal protein L31 |
| 974 | 4474 | 927752 | 927922 | 171 | gp: SC51A_14 | *Streptomyces coelicolor* A3(2) SCF51A.14 | 60.0 | 78.2 | 55 | 50S ribosomal protein L32 |
| 975 | 4475 | 927785 | 927339 | 447 | | | | | | |
| 976 | 4476 | 928117 | 928812 | 696 | sp: COPR_PSESM | *Pseudomonas syringae* copR | 48.0 | 73.6 | 227 | copper-inducible two-component regulator |
| 977 | 4477 | 928884 | 930248 | 1365 | sp: BAES_ECOLI | *Escherichia coli* K12 baeS | 24.4 | 60.1 | 484 | two-component system sensor proteinase |
| 978 | 4478 | 930410 | 931648 | 1239 | pir: S45229 | *Escherichia coli* K12 htrA | 33.3 | 59.9 | 406 | DO precursor |
| 979 | 4479 | 931706 | 932290 | 585 | sp: CNX1_ARATH | *Arabidopsis thaliana* CV cnx1 | 27.7 | 54.3 | 188 | molybdopterin biosynthesis cnx1 protein (molybdenum cofactor biosynthesis enzyme cnx1) |
| 980 | 4480 | 932290 | 932487 | 198 | | | | | | |
| 981 | 4481 | 932974 | 933570 | 405 | sp: MSCL_MYCTU | *Mycobacterium tuberculosis* H37Rv Rv0985c mscL | 50.4 | 77.1 | 131 | large-conductance mechanosensitive channel |
| 982 | 4482 | 933710 | 933060 | 651 | pir: A70601 | *Mycobacterium tuberculosis* H37Rv Rv0990 | 28.6 | 60.0 | 210 | hypothetical protein |
| 983 | 4483 | 934302 | 933733 | 570 | pir: JC4389 | *Homo sapiens* MTHFS | 25.1 | 59.7 | 191 | 5-formyltetrahydrofolate cyclo-ligase |
| 984 | 4484 | 934423 | 935319 | 897 | pir: JC4985 | *Xanthomonas campestris* | 42.2 | 68.9 | 296 | UTP—glucose-1-phosphate uridylyltransferase |
| 985 | 4485 | 935351 | 936607 | 1257 | prf: 2403296B | *Arthrobacter nicotinovorans* moeA | 31.8 | 62.6 | 390 | molybdopterin biosynthesis protein |
| 986 | 4486 | 936615 | 937274 | 660 | sp: RIMI_ECOLI | *Escherichia coli* K12 rimJ | 29.0 | 54.9 | 193 | ribosomal-protein-alanine N-acetyltransferase |
| 987 | 4487 | 937382 | 938401 | 1020 | sp: Y05C_BACSH | *Bacillus sphaericus* E-244 CDase | 30.3 | 54.8 | 367 | hypothetical membrane protein |
| 988 | 4488 | 938427 | 939626 | 1200 | sp: CYNX_ECOLI | *Escherichia coli* K12 cynX | 26.6 | 62.4 | 380 | cyanate transport protein |
| 989 | 4489 | 939217 | 937799 | 1419 | | | | | | |
| 990 | 4490 | 939686 | 940090 | 405 | sp: YG02_HAEIN | *Haemophilus influenzae* Rd HI1602 | 32.1 | 60.6 | 137 | hypothetical membrane protein |
| 991 | 4491 | 940041 | 940754 | 714 | sp: Y05C_MYCTU | *Mycobacterium tuberculosis* H37Rv Rv0093c | 25.3 | 59.6 | 225 | hypothetical membrane protein |
| 992 | 4492 | 940759 | 941925 | 1167 | sp: CDAS_BACSH | *Bacillus sphaericus* E-244 CDase | 26.8 | 53.6 | 444 | cyclomaltodextrinase |
| 993 | 4493 | 943940 | 942381 | 1560 | pir: E70602 | *Mycobacterium tuberculosis* H37Rv | 43.0 | 75.2 | 488 | hypothetical membrane protein |
| 994 | 4494 | 944009 | 944833 | 825 | sp: Y191_MYCTU | *Mycobacterium tuberculosis* H37Rv Rv1003 | 54.0 | 78.3 | 272 | hypothetical protein |
| 995 | 4495 | 946840 | 948669 | 1830 | sp: SYM_METTH | *Methanobacterium thermoautotrophicum* Delta H MTH587 metG | 33.8 | 66.7 | 615 | methionyl-tRNA synthetase |
| 996 | 4496 | 948791 | 950839 | 2049 | prf: 1306383A | *Escherichia coli* recQ | 26.2 | 49.0 | 741 | ATP-dependent DNA helicase |
| 997 | 4497 | 951460 | 950828 | 633 | pir: B69206 | *Methanobacterium thermoautotrophicum* Delta H MTH796 | 27.6 | 53.3 | 210 | hypothetical protein |
| 998 | 4498 | 952991 | 951834 | 1158 | sp: YXAG_BACSU | *Bacillus subtilis* 168 yxaG | 30.0 | 59.0 | 363 | hypothetical protein |
| 999 | 4499 | 953573 | 953043 | 531 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1000 | 4500 | 953973 | 954266 | 294 | gp: AF029727_1 | *Enterococcus faecium* | 33.0 | 59.6 | 94 | transposase |
| 1001 | 4501 | 954277 | 954753 | 477 | pir: TQECI3 | *Escherichia coli* K12 | 41.7 | 67.6 | 139 | transposase |
| 1002 | 4502 | 954941 | 955354 | 414 | gp: AF052055_1 | *Brevibacterium linens* trpA | 73.2 | 88.4 | 112 | transposase subunit |
| 1003 | 4503 | 955911 | 956774 | 864 | | | | | | |
| 1004 | 4504 | 957398 | 955686 | 1713 | prf: 2014253AE | *Escherichia coli* dld | 46.4 | 75.6 | 565 | D-lactate dehydrogenase |
| 1005 | 4505 | 958683 | 957844 | 840 | sp: MTK1_KLEPN | *Klebsiella pneumoniae* OK8 kpnIM | 30.8 | 62.8 | 231 | site-specific DNA-methyltransferase |
| 1006 | 4506 | 959403 | 959185 | 219 | | | | | | |
| 1007 | 4507 | 960081 | 960374 | 294 | gp: AF029727_1 | *Enterococcus faecium* | 33.0 | 59.6 | 94 | transposase |
| 1008 | 4508 | 960385 | 960861 | 477 | pir: TQECI3 | *Escherichia coli* K12 | 41.7 | 67.6 | 139 | transposase |
| 1009 | 4509 | 961297 | 961653 | 357 | sp: YJ94_MYCTU | *Mycobacterium tuberculosis* H37Rv Rv1994c | 62.6 | 84.6 | 91 | transcriptional regulator |
| 1010 | 4510 | 961629 | 962249 | 621 | prf: 2514367A | *Staphylococcus aureus* cadID | 31.7 | 66.8 | 205 | cadmium resistance protein |
| 1011 | 4511 | 961662 | 961321 | 342 | pir: C70603 | *Mycobacterium tuberculosis* H37Rv Rv1008 | 46.4 | 70.7 | 263 | hypothetical protein |
| 1012 | 4512 | 962809 | 963639 | 831 | pir: D70603 | *Mycobacterium tuberculosis* H37Rv Rv1009 rpf | 34.8 | 63.5 | 362 | hypothetical protein |
| 1013 | 4513 | 963864 | 964934 | 1071 | | | | | | |
| 1014 | 4514 | 964974 | 965852 | 879 | sp: KSGA_ECOLI | *Escherichia coli* K12 ksgA | 34.3 | 65.3 | 265 | dimethyladenosine transferase |
| 1015 | 4515 | 965852 | 966784 | 933 | pir: F70603 | *Mycobacterium tuberculosis* H37Rv Rv1011 | 42.5 | 67.0 | 315 | isopentenyl monophosphate kinase |
| 1016 | 4516 | 966591 | 965950 | 642 | | | | | | |
| 1017 | 4517 | 966828 | 968660 | 1833 | pir: S47441 | *Saccharopolyspora erythraea* ertX | 65.5 | 85.8 | 478 | ABC transporter |
| 1018 | 4518 | 968667 | 969458 | 792 | sp: PDXK_ECOLI | *Escherichia coli* K12 pdxK | 40.1 | 67.4 | 242 | pyridoxine kinase |
| 1019 | 4519 | 969940 | 969461 | 480 | sp: YX05_MYCTU | *Mycobacterium tuberculosis* H37Rv Rv2874 | 27.0 | 58.5 | 159 | hypothetical protein |
| 1020 | 4520 | 970029 | 970349 | 321 | gp: SCF1_2 | *Streptomyces coelicolor* A3(2) SCF1.02 | 45.4 | 78.7 | 108 | hypothetical protein |
| 1021 | 4521 | 970418 | 970738 | 321 | gp: SCF1_2 | *Streptomyces coelicolor* A3(2) SCF1.02 | 35.5 | 69.2 | 107 | hypothetical protein |
| 1022 | 4522 | 970864 | 971823 | 960 | gp: SCJ1_15 | *Streptomyces coelicolor* A3(2) SCJ1.15 | 64.8 | 88.1 | 261 | regulator |
| 1023 | 4523 | 973035 | 972244 | 792 | sp: YXEH_BACSU | *Bacillus subtilis* 168 yxeH | 27.2 | 59.1 | 276 | hypothetical protein |
| 1024 | 4524 | 973139 | 974155 | 1017 | pir: E70893 | *Mycobacterium tuberculosis* H37Rv echA9 | 35.6 | 70.9 | 337 | enoyl-CoA hydratase |
| 1025 | 4525 | 973957 | 973304 | 654 | | | | | | |
| 1026 | 4526 | 974186 | 974962 | 777 | | | | | | |
| 1027 | 4527 | 976176 | 974965 | 1212 | | | | | | |
| 1028 | 4528 | 976349 | 977734 | 1386 | sp: CSP1_CORGL | *Corynebacterium glutamicum* (*Brevibacterium flavum*) ATCC 17965 csp1 | 27.7 | 56.8 | 440 | major secreted protein PS1 protein precursor |
| 1029 | 4529 | 978378 | 977800 | 579 | gp: SCF56_6 | *Streptomyces coelicolor* A3(2) SCF56.06 | 44.0 | 70.0 | 100 | transcriptional regulator (tetR family) |
| 1030 | 4530 | 980740 | 978368 | 2373 | gp: SCE87_17 | *Streptomyces coelicolor* A3(2) SCE87.17c | 42.6 | 70.0 | 802 | membrane transport protein |
| 1031 | 4531 | 980993 | 981490 | 498 | sp: MENG_HAEIN | *Haemophilus influenzae* Rd HI0508 menG | 38.2 | 75.8 | 157 | S-adenosylmethionine: 2-demethylmenaquinone methyltransferase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1032 | 4532 | 981622 | 982287 | 666 | gp: NMA6Z2491_214 | Neisseria meningitidis NMA1953 | 29.8 | 63.6 | 121 | hypothetical protein |
| 1033 | 4533 | 982674 | 982294 | 381 | pir: A70539 | Mycobacterium tuberculosis H37Rv Rv1128c | 24.9 | 48.3 | 482 | hypothetical protein |
| 1034 | 4534 | 983100 | 984650 | 1551 | | | | | | |
| 1035 | 4535 | 984910 | 985845 | 936 | | | | | | |
| 1036 | 4536 | 986510 | 984864 | 1647 | pir: IS9305 | Escherichia coli K12 prfC | 39.2 | 68.0 | 546 | peptide-chain-release factor 3 |
| 1037 | 4537 | 986739 | 988007 | 1269 | prf: 2406311A | Methylophilus methylotrophus fmdD | 42.8 | 72.8 | 404 | amide-urea transport protein |
| 1038 | 4538 | 988023 | 988904 | 882 | prf: 2406311B | Methylophilus methylotrophus fmdE | 40.8 | 61.0 | 77 | amide-urea transport protein |
| 1039 | 4539 | 988904 | 989980 | 1077 | prf: 2406311C | Methylophilus methylotrophus fmdF | 34.6 | 68.0 | 234 | amide-urea transport protein |
| 1040 | 4540 | 989980 | 990705 | 726 | sp: BRAF_PSEAE | Pseudomonas aeruginosa PAO braF | 37.9 | 70.0 | 253 | high-affinity branched-chain amino acid transport ATP-binding protein |
| 1041 | 4541 | 990716 | 991414 | 699 | sp: BRAG_PSEAE | Pseudomonas aeruginosa PAO braG | 35.2 | 69.1 | 236 | high-affinity branched-chain amino acid transport ATP-binding protein |
| 1042 | 4542 | 992028 | 991417 | 612 | sp: PTH_ECOLI | Escherichia coli K12 pth | 39.0 | 70.6 | 187 | peptidyl-tRNA hydrolase |
| 1043 | 4543 | 992058 | 993080 | 1023 | sp: 2NPD_WILMR | Williopsis mrakii IFO 0895 | 25.2 | 54.0 | 361 | 2-nitropropane dioxygenase |
| 1044 | 4544 | 993549 | 994613 | 1065 | sp: G3P_ZYMMO | Streptomyces roseofulvus gap | 39.5 | 72.8 | 342 | glyceraldehyde-3-phosphate dehydrogenase |
| 1045 | 4545 | 994474 | 994106 | 369 | GSP: Y75094 | Neisseria meningitidis | 54.0 | 61.0 | 51 | polypeptides predicted to be useful antigens for vaccines and diagnostics |
| 1046 | 4546 | 995375 | 994845 | 531 | sp: PTH_ECOLI | Escherichia coli K12 pth | 38.5 | 63.2 | 174 | peptidyl-tRNA hydrolase |
| 1047 | 4547 | 996126 | 995527 | 600 | pir: B70622 | Mycobacterium tuberculosis H37Rv rplY | 47.0 | 65.0 | 194 | 50S ribosomal protein L25 |
| 1048 | 4548 | 996402 | 996830 | 429 | sp: LGUL_SALTY | Salmonella typhimurium D21 gloA | 28.7 | 54.6 | 143 | lactoylglutathione lyase |
| 1049 | 4549 | 997456 | 996833 | 624 | prf: 2516401BW | Bacillus cereus ATCC 10987 alkD | 38.9 | 62.5 | 208 | DNA alkylation repair enzyme |
| 1050 | 4550 | 998440 | 997466 | 975 | sp: KPRS_BACCL | Bacillus subtilis prs | 44.0 | 79.1 | 316 | ribose-phosphate pyrophosphokinase |
| 1051 | 4551 | 999909 | 998455 | 1455 | pir: S66080 | Bacillus subtilis gcaD | 42.0 | 71.9 | 452 | UDP-N-acetylglucosamine pyrophosphorylase |
| 1052 | 4552 | 1001242 | 1000016 | 1227 | | | | | | |
| 1053 | 4553 | 1001332 | 1002864 | 1533 | sp: SUFI_ECOLI | Escherichia coli K12 sufI | 30.8 | 61.7 | 506 | sufI protein precursor |
| 1054 | 4554 | 1003013 | 1003930 | 918 | sp: NODI_RHIS3 | Rhizobium sp. N33 nodI | 35.8 | 64.8 | 310 | nodulation ATP-binding protein I |
| 1055 | 4555 | 1003953 | 1004783 | 831 | pir: JN0850 | Streptomyces lividans ORF2 | 30.2 | 63.2 | 272 | hypothetical membrane protein |
| 1056 | 4556 | 1004829 | 1006085 | 1257 | sp: UHPB_ECOLI | Escherichia coli K12 uhpB | 24.6 | 48.4 | 459 | two-component system sensor histidine kinase |
| 1057 | 4557 | 1006089 | 1006697 | 609 | prf: 2107255A | Streptomyces peucetius dnrN | 36.6 | 67.3 | 202 | two component transcriptional regulator (luxR family) |
| 1058 | 4558 | 1006937 | 1006734 | 204 | | | | | | |
| 1059 | 4559 | 1006998 | 1008152 | 1155 | gp: SCF15_7 | Streptomyces coelicolor A3(2) SCF15.07 | 31.5 | 64.5 | 349 | hypothetical membrane protein |
| 1060 | 4560 | 1008622 | 1010061 | 1440 | pir: S65587 | Streptomyces glaucescens strV | 28.6 | 57.0 | 535 | ABC transporter |
| 1061 | 4561 | 1008686 | 1008534 | 153 | | | | | | |
| 1062 | 4562 | 1010057 | 1011790 | 1734 | pir: T14180 | Mycobacterium smegmatis exiT | 44.0 | 74.0 | 573 | ABC transporter |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1063 | 4563 | 1013761 | 1011797 | 1965 | sp: GGT_ECOLI | *Escherichia coli* K12 ggt | 32.4 | 58.6 | 666 | gamma-glutamyltranspeptidase precursor |
| 1064 | 4564 | 1014016 | 1014264 | 249 | | | | | | |
| 1065 | 4565 | 1014861 | 1014343 | 519 | | | | | | |
| 1066 | 4566 | 1014925 | 1015116 | 192 | | | | | | |
| 1067 | 4567 | 1015652 | 1016560 | 909 | | | | | | |
| 1068 | 4568 | 1015692 | 1015450 | 243 | GPU: AF164956_23 | *Corynebacterium glutamicum* TnpNC | 64.0 | 72.0 | 37 | transposase protein fragment |
| 1069 | 4569 | 1015852 | 1015145 | 708 | gp: AF121000_8 | *Corynebacterium glutamicum* 22243 R-plasmid pAG1 tnpB | 99.6 | 100.0 | 236 | transposase (IS1628 TnpB) |
| 1070 | 4570 | 1016557 | 1017018 | 462 | | | | | | |
| 1071 | 4571 | 1017870 | 1017274 | 597 | | | | | | |
| 1072 | 4572 | 1018082 | 1018393 | 312 | | | | | | |
| 1073 | 4573 | 1018416 | 1019066 | 651 | sp: TETC_ECOLI | *Escherichia coli* tetR | 23.0 | 59.6 | 183 | transcriptional regulator (TetR-family) |
| 1074 | 4574 | 1019090 | 1022716 | 3627 | sp: MFD_ECOLI | *Escherichia coli* mfd | 36.2 | 65.1 | 1217 | transcription/repair-coupling protein |
| 1075 | 4575 | 1020613 | 1019390 | 1224 | | | | | | |
| 1076 | 4576 | 1021305 | 1021078 | 228 | GSP: Y75301 | *Neisseria gonorrhoeae* | 48.0 | 69.0 | 76 | Neisserial polypeptides predicted to be useful antigens for vaccines and diagnostics |
| 1077 | 4577 | 1024666 | 1022699 | 1968 | sp: MDLB_ECOLI | *Escherichia coli* mdlB | 31.3 | 62.7 | 632 | multidrug resistance-like ATP-binding protein, ABC-type transport protein |
| 1078 | 4578 | 1026396 | 1024666 | 1731 | sp: YC73_MYCTU | *Mycobacterium tuberculosis* H37Rv Rv1273c | 50.2 | 81.9 | 574 | ABC transporter |
| 1079 | 4579 | 1026886 | 1026505 | 2382 | sp: YLI3_CORGL | *Corynebacterium glutamicum* ATCC 13032 orf3 | 100.0 | 100.0 | 368 | hypothetical membrane protein |
| 1080 | 4580 | 1031885 | 1032181 | 297 | sp: YABN_BACSU | *Bacillus subtilis* yabN | 33.4 | 57.4 | 183 | hypothetical protein |
| 1081 | 4581 | 1032196 | 1032780 | 585 | | | | | | |
| 1082 | 4582 | 1033185 | 1032760 | 426 | | | | | | |
| 1083 | 4583 | 1033646 | 1033269 | 378 | | | | | | |
| 1084 | 4584 | 1033954 | 1034739 | 786 | pir: A70623 | *Mycobacterium tuberculosis* H37Rv Rv1022 lpqU | 46.5 | 68.9 | 241 | lpqU protein |
| 1085 | 4585 | 1034949 | 1036223 | 1275 | sp: ENO_BACSU | *Bacillus subtilis* eno | 64.5 | 86.0 | 422 | enolase (2-phosphoglycerate dehydratase)(2-phospho-D-glycerate hydro-lyase) |
| 1086 | 4586 | 1036159 | 1036016 | 144 | PIR: B72477 | *Aeropyrum pernix* K1 APE2459 | 68.0 | 58.0 | 41 | hypothetical protein |
| 1087 | 4587 | 1036316 | 1036855 | 540 | pir: C70623 | *Mycobacterium tuberculosis* H37Rv Rv1023 | 31.9 | 55.0 | 191 | hypothetical protein |
| 1088 | 4588 | 1036900 | 1037445 | 546 | pir: D70623 | *Mycobacterium tuberculosis* H37Rv Rv1024 | 59.5 | 77.8 | 153 | hypothetical protein |
| 1089 | 4589 | 1037448 | 1038410 | 963 | sp: GPPA_ECOLI | *Escherichia coli* gppA | 25.2 | 55.0 | 329 | guanosine pentaphosphatase or exopolyphosphatase |
| 1090 | 4590 | 1037481 | 1036498 | 984 | | | | | | |
| 1091 | 4591 | 1039650 | 1038721 | 930 | sp: THD2_ECOLI | *Escherichia coli* tdcB | 30.3 | 64.7 | 314 | threonine dehydratase |
| 1092 | 4592 | 1039783 | 1039977 | 195 | | | | | | |
| 1093 | 4593 | 1039996 | 1040325 | 330 | | | | | | |
| 1094 | 4594 | 1040494 | 1040682 | 189 | pir: B72287 | *Thermotoga maritima* MSB8 | 46.3 | 74.1 | 56 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1095 | 4595 | 1040925 | 1041917 | 993 | sp: RHAR_ECOLI | Escherichia coli rhaR | 24.8 | 55.8 | 242 | transcription activator of L-rhamnose operon |
| 1096 | 4596 | 1042027 | 1042842 | 816 | pir: F70893 | Mycobacterium tuberculosis H37Rv Rv1072 | 57.8 | 80.1 | 282 | hypothetical protein |
| 1097 | 4597 | 1043236 | 1042850 | 387 | | | | | | hypothetical protein |
| 1098 | 4598 | 1043747 | 1043298 | 450 | gp: SCF55_39 | Streptomyces coelicolor A3(2) SCF55.39 | 30.0 | 57.1 | 140 | |
| 1099 | 4599 | 1044295 | 1043774 | 522 | sp: GREA_ECOLI | Escherichia coli greA | 35.0 | 60.1 | 143 | transcription elongation factor |
| 1100 | 4600 | 1044959 | 1044477 | 483 | pir: G70894 | Mycobacterium tuberculosis H37Rv Rv1081c | 34.3 | 72.1 | 140 | hypothetical protein |
| 1101 | 4601 | 1045158 | 1046030 | 873 | pir: S44952 | Streptomyces lincolnensis lmbE | 31.7 | 56.3 | 300 | lincomycin-production |
| 1102 | 4602 | 1046073 | 1046390 | 318 | | | | | | |
| 1103 | 4603 | 1046610 | 1047707 | 1098 | sp: AROG_CORGL | Corynebacterium glutamicum aroG | 99.2 | 99.5 | 367 | 3-deoxy-D-arabino-heptulosonate-7-phosphate synthase |
| 1104 | 4604 | 1047452 | 1046820 | 633 | sp: YARF_CORGL | Corynebacterium glutamicum CCRC18310 | 96.0 | 97.3 | 97 | hypothetical protein or undecaprenyl pyrophosphate synthetase |
| 1105 | 4605 | 1047827 | 1048501 | 675 | SP: YARF_CORGL | Corynebacterium glutamicum (Brevibacterium flavum) | 100.0 | 100.0 | 28 | hypothetical protein |
| 1106 | 4606 | 1048356 | 1048529 | 174 | | | | | | |
| 1107 | 4607 | 1048525 | 1049043 | 519 | | | | | | |
| 1108 | 4608 | 1049385 | 1049068 | 318 | | | | | | |
| 1109 | 4609 | 1050362 | 1049427 | 936 | sp: COAA_ECOLI | Escherichia coli coaA | 53.9 | 79.9 | 308 | pantothenate kinase |
| 1110 | 4610 | 1050624 | 1051925 | 1302 | gsp: R97745 | Brevibacterium flavum MJ-233 glyA | 99.5 | 100.0 | 434 | serine hydroxymethyl transferase |
| 1111 | 4611 | 1052021 | 1053880 | 1860 | sp: PABS_STRGR | Streptomyces griseus pabS | 47.6 | 70.1 | 898 | p-aminobenzoic acid synthase |
| 1112 | 4612 | 1053880 | 1054602 | 723 | | | | | | |
| 1113 | 4613 | 1054859 | 1055722 | 864 | | | | | | |
| 1114 | 4614 | 1055032 | 1054600 | 393 | | | | | | |
| 1115 | 4615 | 1055783 | 1056319 | 537 | gp: A01504_1 | Alcaligenes faecalis ptcR | 30.3 | 58.8 | 165 | phosphinothricin resistance protein |
| 1116 | 4616 | 1057200 | 1056322 | 879 | sp: YBGK_ECOLI | Escherichia coli ybgK | 30.3 | 59.0 | 300 | hypothetical protein |
| 1117 | 4617 | 1057573 | 1058628 | 1056 | | | | | | |
| 1118 | 4618 | 1057868 | 1057200 | 669 | sp: YBGJ_ECOLI | Escherichia coli ybgJ | 37.8 | 57.8 | 225 | hypothetical protein |
| 1119 | 4619 | 1058598 | 1057843 | 756 | sp: LAMB_EMENI | Emericella nidulans lamB | 30.8 | 52.2 | 276 | lactam utilization protein |
| 1120 | 4620 | 1059214 | 1058624 | 591 | sp: YCSH_BACSU | Bacillus subtilis ycsH | 40.6 | 81.2 | 165 | hypothetical membrane protein |
| 1121 | 4621 | 1059218 | 1059889 | 672 | | | | | | |
| 1122 | 4622 | 1059360 | 1059962 | 603 | | | | | | |
| 1123 | 4623 | 1060112 | 1060792 | 681 | sp: YDHC_BACSU | Bacillus subtilis ydhC | 26.0 | 63.2 | 204 | transcriptional regulator |
| 1124 | 4624 | 1060869 | 1062146 | 1278 | sp: FUMH_RAT | Rattus norvegicus (Rat) fumH | 52.0 | 79.4 | 456 | fumarate hydratase precursor |
| 1125 | 4625 | 1063629 | 1062211 | 1419 | gp: AF048979_1 | Rhodococcus erythropolis IGTS8 dszD | 32.7 | 65.4 | 159 | NADH-dependent FMN oxydoreductase |
| 1126 | 4626 | 1063936 | 1064424 | 489 | | | | | | |
| 1127 | 4627 | 1064738 | 1064478 | 261 | | | | | | |
| 1128 | 4628 | 1065200 | 1064754 | 447 | gp: SCAH10_16 | Streptomyces coelicolor A3(2) StAH10.16 | 55.4 | 81.0 | 184 | reductase |
| 1129 | 4629 | 1065867 | 1065304 | 564 | | | | | | |
| 1130 | 4630 | 1066083 | 1067570 | 1488 | sp: SOXA_RHOSO | Rhodococcus sp. IGTS8 soxA | 39.1 | 67.7 | 443 | dibenzothiophene desulfurization enzyme A |
| 1131 | 4631 | 1067570 | 1068649 | 1080 | sp: SOXC_RHOSO | Rhodococcus sp. IGTS8 soxC | 25.8 | 51.3 | 372 | dibenzothiophene desulfurization enzyme C (DBT sulfur dioxygenase) |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1132 | 4632 | 1068649 | 1069845 | 1197 | sp: SOXC_RHOSO | *Rhodococcus* sp. IGTS8 soxC | 28.9 | 61.6 | 391 | dibenzothiophene desulfurization enzyme C (DBT sulfur dioxygenase) |
| 1133 | 4633 | 1069692 | 1068913 | 780 | | | | | | |
| 1134 | 4634 | 1069808 | 1069119 | 690 | | | | | | |
| 1135 | 4635 | 1069959 | 1071134 | 1176 | gp: ECO237695_3 | *Escherichia coli* K12 ssuD | 45.3 | 73.1 | 397 | FMNH2-dependent aliphatic sulfonate monooxygenase |
| 1136 | 4636 | 1072441 | 1071479 | 963 | sp: GLPX_ECOLI | *Escherichia coli* K12 glpX | 44.3 | 75.7 | 325 | glycerol metabolism |
| 1137 | 4637 | 1072676 | 1073245 | 570 | pir: B70897 | *Mycobacterium tuberculosis* H37Rv Rv1100 | 27.5 | 56.4 | 211 | hypothetical protein |
| 1138 | 4638 | 1075241 | 1073340 | 1902 | pir: H70062 | *Bacillus subtilis* ywmD | 31.3 | 66.1 | 227 | hypothetical protein |
| 1139 | 4639 | 1075357 | 1075641 | 285 | | | | | | |
| 1140 | 4640 | 1075553 | 1075329 | 225 | gp: SCH24_37 | *Streptomyces coelicolor* A3(2) SCH24.37 | 36.6 | 78.1 | 82 | transmembrane efflux protein |
| 1141 | 4641 | 1075909 | 1075667 | 243 | sp: EX7S_ECOLI | *Escherichia coli* K12 MG1655 xseB | 40.3 | 67.7 | 62 | exodeoxyribonuclease small subunit |
| 1142 | 4642 | 1077183 | 1075933 | 1251 | sp: EX7L_ECOLI | *Escherichia coli* K12 MG1655 xseA | 30.0 | 55.6 | 466 | exodeoxyribonuclease large subunit |
| 1143 | 4643 | 1077297 | 1078271 | 975 | sp: LYTB_ECOLI | *Escherichia coli* K12 lytB | 50.2 | 78.8 | 311 | penicillin tolerance |
| 1144 | 4644 | 1077734 | 1077306 | 429 | GSP: Y75421 | *Neisseria gonorrhoeae* | 33.0 | 47.0 | 131 | polypeptides predicted to be useful antigens for vaccines and diagnostics |
| 1145 | 4645 | 1079146 | 1078319 | 828 | sp: PERM_ECOLI | *Escherichia coli* K12 permE | 26.3 | 63.9 | 338 | permease |
| 1146 | 4646 | 1080540 | 1079221 | 1320 | sp: NTPR_RAT | *Rattus norvegicus* (Rat) SLC6A7 ntpR | 30.3 | 61.4 | 552 | sodium-dependent proline transporter |
| 1147 | 4647 | 1080965 | 1080786 | 180 | | | | | | |
| 1148 | 4648 | 1082708 | 1080972 | 1737 | | | | | | |
| 1149 | 4649 | 1084183 | 1082951 | 1233 | sp: CSP1_CORGL | *Corynebacterium glutamicum* (*Brevibacterium flavum*) ATCC 17965 csp1 | 29.9 | 60.0 | 412 | major secreted protein PS1 protein precursor |
| 1150 | 4650 | 1084380 | 1085462 | 1083 | sp: YYAF_BACSU | *Bacillus subtilis* yyaF | 70.1 | 88.6 | 361 | GTP-binding protein |
| 1151 | 4651 | 1085791 | 1086087 | 297 | sp: VAPI_BACNO | *Dichelobacter nodosus* intA | 57.3 | 80.0 | 75 | virulence-associated protein |
| 1152 | 4652 | 1086096 | 1086917 | 822 | sp: OTCA_PSEAE | *Pseudomonas aeruginosa* argF | 29.6 | 58.8 | 301 | ornithine carbamoyltransferase |
| 1153 | 4653 | 1087544 | 1087044 | 501 | sp: YKKB_BACSU | *Bacillus subtilis* 168 ykkB | 39.2 | 69.9 | 143 | hypothetical protein |
| 1154 | 4654 | 1088293 | 1087664 | 630 | gp: AF013288_1 | *Mus musculus* RDH4 | 33.8 | 60.6 | 198 | 9-cis retinol dehydrogenase or oxidoreductase |
| 1155 | 4655 | 1089740 | 1088535 | 1206 | sp: YIS1_STRCO | *Streptomyces coelicolor* SC3C8.10 | 42.2 | 73.0 | 396 | transposase/integrase (IS110) |
| 1156 | 4656 | 1090175 | 1093216 | 3042 | sp: YEGE_ECOLI | *Escherichia coli* K12 yegE | 23.0 | 52.2 | 1153 | hypothetical membrane protein |
| 1157 | 4657 | 1093929 | 1094693 | 765 | sp: NODC_RHIME | *Rhizobium meliloti* nodC | 22.8 | 47.1 | 259 | N-acetylglucosaminyltransferase |
| 1158 | 4658 | 1094693 | 1094911 | 219 | | | | | | |
| 1159 | 4659 | 1095052 | 1095384 | 333 | | | | | | |
| 1160 | 4660 | 1095677 | 1095387 | 291 | pir: S43613 | *Corynebacterium glutamicum* ATCC 31831 | 82.5 | 93.8 | 97 | transposase (insertion sequence IS31831) |
| 1161 | 4661 | 1096093 | 1095719 | 375 | pir: JC4742 | *Corynebacterium glutamicum* (*Brevibacterium lactofermentum*) ATCC 13869 | 79.2 | 94.4 | 125 | transposase |
| 1162 | 4662 | 1096331 | 1096188 | 144 | pir: JC4742 | *Corynebacterium glutamicum* (*Brevibacterium lactofermentum*) ATCC 13869 | 87.5 | 95.8 | 48 | transposase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1163 | 4663 | 1096471 | 1096331 | 141 | | | | | | |
| 1164 | 4664 | 1097111 | 1096746 | 366 | | | | | | |
| 1165 | 4665 | 1097229 | 1097726 | 498 | | | | | | |
| 1166 | 4666 | 1097750 | 1098592 | 843 | sp: MORA_PSEPU | *Pseudomonas putida* M10 norA | 37.5 | 66.3 | 264 | oxidoreductase or morpyine-6-dehydrogenase (naloxone reductase) |
| 1167 | 4667 | 1098609 | 1098929 | 321 | sp: DC4C_ACICA | *Acinetobacter calcoaceticus* dc4c | 33.3 | 63.9 | 108 | 4-carboxymuconolactone decarboxylase |
| 1168 | 4668 | 1099088 | 1099750 | 663 | | | | | | |
| 1169 | 4669 | 1099209 | 1099015 | 195 | | | | | | |
| 1170 | 4670 | 1099768 | 1099115 | 654 | gp: AF058302_19 | *Streptomyces roseofulvus* frnS | 34.9 | 66.4 | 146 | frenolicin gene cluster protein involved in frenolicin biosynthetic |
| 1171 | 4671 | 1099917 | 1101653 | 1737 | gp: SPU59234_3 | *Synechococcus* sp. PCC 7942 accC | 48.1 | 78.5 | 563 | biotin carboxylase |
| 1172 | 4672 | 1102043 | 1102639 | 597 | | | | | | |
| 1173 | 4673 | 1102695 | 1103192 | 498 | | | | | | |
| 1174 | 4674 | 1103180 | 1103524 | 345 | | | | | | |
| 1175 | 4675 | 1103951 | 1104103 | 153 | | | | | | |
| 1176 | 4676 | 1104923 | 1105561 | 639 | | | | | | |
| 1177 | 4677 | 1106058 | 1104103 | 1956 | sp: YT15_MYCTU | *Mycobacterium tuberculosis* H37Rv Rv0959 | 57.9 | 80.3 | 655 | hypothetical protein |
| 1178 | 4678 | 1107381 | 1106086 | 1296 | sp: BCHI_RHOSH | *Rhodobacter sphaeroides* ATCC 17023 bchI | 27.7 | 52.6 | 329 | magnesium chelatase subunit |
| 1179 | 4679 | 1107560 | 1108201 | 642 | gp: AMU73808_1 | *Amycolatopsis methanolica* pgm | 33.8 | 62.5 | 160 | 2,3-PDG dependent phosphoglycerate mutase |
| 1180 | 4680 | 1108201 | 1108905 | 705 | pir: A70577 | *Mycobacterium tuberculosis* H37Rv Rv2133c | 38.2 | 60.7 | 262 | hypothetical protein |
| 1181 | 4681 | 1108993 | 1109754 | 762 | gp: STMBCPA_1 | *Streptomyces hygroscopicus* SF1293 BcpA | 29.4 | 59.3 | 248 | carboxyphosphonoenolpyruvate phosphonomutase |
| 1182 | 4682 | 1109792 | 1111432 | 1641 | sp: TLRC_STRFR | *Streptomyces fradiae* tlrC | 31.7 | 54.1 | 593 | tyrosin resistance ATP-binding protein |
| 1183 | 4683 | 1111820 | 1111425 | 396 | sp: Y06C_MYCTU | *Mycobacterium tuberculosis* H37Rv Rv2923c | 29.4 | 66.9 | 136 | hypothetical protein |
| 1184 | 4684 | 1111889 | 1112230 | 342 | sp: PHNA_ECOLI | *Escherichia coli* K12 MG1655 phnA | 55.0 | 82.0 | 111 | alkylphosphonate uptake protein |
| 1185 | 4685 | 1112957 | 1112484 | 474 | sp: YXAD_BACSU | *Bacillus subtilis* 168 yxaD | 32.1 | 62.7 | 134 | transcriptional regulator |
| 1186 | 4686 | 1113102 | 1114319 | 1218 | gp: SPN7367_1 | *Streptococcus pneumoniae* pmrA | 22.6 | 59.4 | 367 | multi-drug resistance efflux pump |
| 1187 | 4687 | 1114486 | 1115793 | 1308 | pir: S43613 | *Corynebacterium glutamicum* (*Brevibacterium lactofermentum*) ATCC 31831 | 99.5 | 99.8 | 436 | transposase (insertion sequence IS31831) |
| 1188 | 4688 | 1116905 | 1115832 | 1074 | gp: RFAJ3152_2 | *Ruminococcus flavefaciens* cysteine desulphurase gene | 43.9 | 73.4 | 376 | cysteine desulphurase |
| 1189 | 4689 | 1117744 | 1116908 | 837 | sp: NADC_MYCTU | *Mycobacterium tuberculosis* | 42.1 | 68.9 | 283 | nicotinate-nucleotide pyrophosphorylase |
| 1190 | 4690 | 1118932 | 1117751 | 1182 | pir: E69663 | *Bacillus subtilis* nadA | 49.3 | 77.6 | 361 | quinolinate synthetase A |
| 1191 | 4691 | 1119727 | 1119086 | 642 | gp: SC5B8_7 | *Streptomyces coelicolor* SC5B8.07 | 37.0 | 60.9 | 235 | DNA hydrolase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1192 | 4692 | 1120205 | 1120804 | 600 | gp: AE001961_5 | *Deinococcus radiodurans* R1 DR1112 | 23.4 | 54.7 | 192 | hypothetical membrane protein |
| 1193 | 4693 | 1121432 | 1120833 | 600 | gp: SC3A7_8 | *Streptomyces coelicolor* SC3A7.08 | 36.0 | 66.4 | 214 | hypothetical protein |
| 1194 | 4694 | 1121809 | 1121468 | 342 | sp: YBDF_ECOLI | *Escherichia coli* K12 MG1655 ybdF | 41.7 | 74.1 | 108 | hypothetical protein |
| 1195 | 4695 | 1122606 | 1121818 | 789 | gp: AAA21740_1 | *Escherichia coli* K12 lplA | 30.1 | 60.7 | 216 | lipoate-protein ligase A |
| 1196 | 4696 | 1123051 | 1123461 | 411 | sp: PHNB_ECOLI | *Escherichia coli* K12 phnB | 29.7 | 60.8 | 148 | alkylphosphonate uptake protein and C-P lyase activity |
| 1197 | 4697 | 1124826 | 1123534 | 1293 | sp: PCAK_PSEPU | *Pseudomonas putida* pcaK | 28.8 | 64.3 | 420 | transmembrane transport protein or 4-hydroxybenzoate transporter |
| 1198 | 4698 | 1126020 | 1124836 | 1185 | sp: PHHY_PSEAE | *Pseudomonas aeruginosa* phhy | 40.8 | 68.6 | 395 | p-hydroxybenzoate hydroxylase (4-hydroxybenzoate 3-monooxygenase) |
| 1199 | 4699 | 1126422 | 1127009 | 588 | pir: A69859 | *Bacillus subtilis* 168 ykoE | 36.7 | 69.6 | 191 | hypothetical membrane protein |
| 1200 | 4700 | 1127013 | 1128350 | 1338 | sp: YJJK_ECOLI | *Escherichia coli* yjjK | 24.8 | 47.6 | 532 | ABC transporter ATP-binding protein |
| 1201 | 4701 | 1128350 | 1129102 | 753 | pir: G69858 | *Bacillus subtilis* 168 ykoC | 25.6 | 61.6 | 250 | hypothetical membrane protein |
| 1202 | 4702 | 1129102 | 1129632 | 531 | | | | | | |
| 1203 | 4703 | 1129655 | 1130704 | 1050 | sp: CHAA_ECOLI | *Escherichia coli* chaA | 33.3 | 69.0 | 339 | Ca2+/H+ antiporter ChaA |
| 1204 | 4704 | 1130721 | 1131428 | 708 | pir: C75001 | *Pyrococcus abyssi* Orsay PAB1341 | 28.4 | 57.6 | 236 | hypothetical protein |
| 1205 | 4705 | 1132123 | 1131401 | 723 | sp: YWAF_BACSU | *Bacillus subtilis* ywaF | 27.6 | 61.1 | 221 | hypothetical membrane protein |
| 1206 | 4706 | 1134472 | 1132133 | 2340 | sp: UVRA_THETH | *Thermus thermophilus* unrA | 35.5 | 58.7 | 946 | excinuclease ABC subunit A |
| 1207 | 4707 | 1134561 | 1135055 | 495 | sp: TPX_MYCTU | *Mycobacterium tuberculosis* H37Rv tpx | 57.3 | 81.7 | 164 | thioredoxin peroxidase |
| 1208 | 4708 | 1135476 | 1135691 | 216 | | | | | | |
| 1209 | 4709 | 1136833 | 1135058 | 1776 | | | | | | |
| 1210 | 4710 | 1137891 | 1136938 | 954 | sp: YEDL_ECOLI | *Escherichia coli* yedL | 39.9 | 72.0 | 318 | hypothetical membrane protein oxidoreductase or thiamin biosynthesis protein |
| 1211 | 4711 | 1137960 | 1138859 | 900 | gp: SCF76_2 | *Streptomyces coelicolor* A3(2) | 34.0 | 49.0 | 282 | |
| 1212 | 4712 | 1138880 | 1139245 | 366 | | | | | | |
| 1213 | 4713 | 1139196 | 1139492 | 297 | | | | | | |
| 1214 | 4714 | 1139357 | 1139617 | 261 | | | | | | |
| 1215 | 4715 | 1140021 | 1139635 | 387 | | | | | | |
| 1216 | 4716 | 1140861 | 1140028 | 834 | sp: CTR2_PENVA | *Penaeus vannamei* | 28.8 | 51.3 | 271 | chymotrypsin BII |
| 1217 | 4717 | 1141245 | 1140901 | 345 | sp: ARC2_ECOLI | *Escherichia coli* | 43.2 | 72.1 | 111 | arsenate reductase (arsenical pump modifier) |
| 1218 | 4718 | 1141273 | 1142472 | 1200 | sp: YYAD_BACSU | *Bacillus subtilis* yyaD | 23.5 | 62.4 | 340 | hypothetical membrane protein |
| 1219 | 4719 | 1143015 | 1142479 | 537 | pir: F70559 | *Mycobacterium tuberculosis* H37Rv Rv1632c | 43.5 | 71.4 | 147 | hypothetical protein |
| 1220 | 4720 | 1143739 | 1143026 | 714 | pir: F70555 | *Mycobacterium tuberculosis* H37Rv Rv1157c | 35.8 | 62.9 | 221 | hypothetical protein |
| 1221 | 4721 | 1144118 | 1146028 | 1911 | sp: TYPA_ECOLI | *Escherichia coli* K12 typA | 46.3 | 76.7 | 614 | GTP-binding protein (tyrosine phsphorylated protein A) |
| 1222 | 4722 | 1146097 | 1147602 | 1506 | pir: F70874 | *Mycobacterium tuberculosis* H37Rv Rv1166 | 27.9 | 54.9 | 506 | hypothetical protein |
| 1223 | 4723 | 1147592 | 1148461 | 870 | pir: B70875 | *Mycobacterium tuberculosis* H37Rv Rv1170 | 38.7 | 61.9 | 315 | hypothetical protein |
| 1224 | 4724 | 1148445 | 1148882 | 438 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1225 | 4725 | 1148953 | 1149267 | 315 | sp: FER_STRGR | *Streptomyces griseus* fer | 78.6 | 91.3 | 103 | ferredoxin [4Fe-4S] |
| 1226 | 4726 | 1149279 | 1150379 | 1101 | sp: AAT_BACSP | *Bacillus* sp: strain YM-2 aat | 25.9 | 52.9 | 397 | aspartate aminotransferase |
| 1227 | 4727 | 1150408 | 1151028 | 621 | | | | | | |
| 1228 | 4728 | 1151186 | 1152370 | 1185 | | | | | | |
| 1229 | 4729 | 1153263 | 1152373 | 891 | gp: CGAJ4934_1 | *Corynebacterium glutamicum* ATCC 13032 dapD | 100.0 | 100.0 | 229 | tetrahydrodipicolinate succinylase or succinylation of piperidine-2,6-dicarboxylate |
| 1230 | 4730 | 1156537 | 1155875 | 663 | | | | | | |
| 1231 | 4731 | 1156902 | 1157669 | 768 | pir: S60064 | *Corynebacterium glutamicum* ATCC 13032 orf2 | 100.0 | 100.0 | 211 | hypothetical protein |
| 1232 | 4732 | 1157694 | 1158524 | 831 | gp: SCP8_4 | *Streptomyces coelicolor* A3(2) dhpS | 59.0 | 69.0 | 273 | dihydropteroate synthase |
| 1233 | 4733 | 1158524 | 1159252 | 729 | gp: MLU15180_14 | *Mycobacterium leprae* u17561 | 45.7 | 73.1 | 245 | hypothetical protein |
| 1234 | 4734 | 1159267 | 1159572 | 306 | pir: G70609 | *Mycobacterium tuberculosis* H37Rv Rv1209 | 31.3 | 67.7 | 99 | hypothetical protein |
| 1235 | 4735 | 1159635 | 1159799 | 165 | gsp: W32443 | *Mycobacterium tuberculosis* | 72.3 | 91.5 | 47 | antigen TbAAMK, useful in vaccines for prevention or treatment of tuberculosis |
| 1236 | 4736 | 1159865 | 1160728 | 864 | sp: MYRA_MICGR | *Micromonospora griseorubida* myrA | 39.2 | 67.8 | 286 | mycinamicin-resistance gene |
| 1237 | 4737 | 1162231 | 1160738 | 1494 | sp: SCRB_PEDPE | *Pediococcus pentosaceus* scrB | 23.5 | 51.0 | 524 | sucrose-6-phosphate hydrolase |
| 1238 | 4738 | 1163605 | 1162379 | 1227 | sp: GLGA_ECOLI | *Escherichia coli* K12 MG1655 glgA | 24.7 | 51.3 | 433 | ADPglucose—starch(bacterial glycogen) glucosyltransferase |
| 1239 | 4739 | 1163702 | 1164916 | 1215 | sp: GLGC_STRCO | *Streptomyces coelicolor* A3(2) glgC | 61.0 | 81.8 | 400 | glucose-1-phosphate adenylyltransferase |
| 1240 | 4740 | 1165612 | 1164974 | 639 | sp: MDMC_STRMY | *Streptomyces mycarofaciens* MdmC | 25.8 | 62.4 | 93 | methyltransferase |
| 1241 | 4741 | 1165746 | 1166384 | 639 | sp: RPOE_ECOLI | *Escherichia coli* rpoE | 27.3 | 57.2 | 194 | RNA polymerase sigma factor (sigma-24); heat shock and oxidative stress |
| 1242 | 4742 | 1166576 | 1167067 | 492 | | | | | | |
| 1243 | 4743 | 1167110 | 1167577 | 468 | pir: C70508 | *Mycobacterium tuberculosis* H37Rv Rv1224 | 45.5 | 73.2 | 112 | hypothetical protein |
| 1244 | 4744 | 1168711 | 1167587 | 1125 | sp: MRP_ECOLI | *Escherichia coli* mrp | 43.6 | 72.0 | 257 | ATPase |
| 1245 | 4745 | 1169325 | 1168747 | 579 | pir: B70509 | *Mycobacterium tuberculosis* H37Rv Rv1231c | 60.4 | 83.8 | 154 | hypothetical protein |
| 1246 | 4746 | 1170610 | 1169321 | 1290 | pir: C70509 | *Mycobacterium tuberculosis* H37Rv Rv1232c | 49.8 | 77.0 | 434 | hypothetical protein |
| 1247 | 4747 | 1170672 | 1171187 | 516 | pir: A70952 | *Mycobacterium tuberculosis* H37Rv Rv1234 | 57.9 | 87.1 | 140 | hypothetical protein |
| 1248 | 4748 | 1171206 | 1171871 | 666 | | | | | | |
| 1249 | 4749 | 1172462 | 1171869 | 594 | | | | | | |
| 1250 | 4750 | 1176271 | 1172501 | 3771 | prf: 2306367A | *Corynebacterium glutamicum* AJ12036 odhA | 99.4 | 99.8 | 1257 | 2-oxoglutarate dehydrogenase |
| 1251 | 4751 | 1180048 | 1176308 | 3741 | sp: MDR2_CRIGR | *Cricetulus griseus* (Chinese hamster) MDR2 | 28.8 | 60.4 | 1288 | ABC transporter or multidrug resistance protein 2 (P-glycoprotein 2) |
| 1252 | 4752 | 1180837 | 1180121 | 717 | pir: H70953 | *Mycobacterium tuberculosis* H37Rv Rv1249c | 31.7 | 72.1 | 240 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1253 | 4753 | 1181675 | 1180872 | 804 | sp: AROE_ECOLI | Escherichia coli aroE | 25.5 | 61.2 | 255 | shikimate dehydrogenase |
| 1254 | 4754 | 1181993 | 1183603 | 1611 | sp: PNBA_BACSU | Bacillus subtilis pnbA | 35.7 | 64.7 | 501 | para-nitrobenzyl esterase |
| 1255 | 4755 | 1183607 | 1184257 | 651 | | | | | | |
| 1256 | 4756 | 1184280 | 1185155 | 876 | | | | | | |
| 1257 | 4757 | 1185742 | 1185218 | 525 | | | | | | |
| 1258 | 4758 | 1185825 | 1187039 | 1215 | sp: TCR1_ECOLI | Escherichia coli transposon Tn1721 tetA | 27.1 | 61.4 | 409 | tetracycline resistance protein |
| 1259 | 4759 | 1187043 | 1188389 | 1347 | sp: TCMA_STRGA | Streptomyces glaucescens tcmA | 32.4 | 64.2 | 444 | metabolite export pump of tetracenomycin C resistance |
| 1260 | 4760 | 1189822 | 1190526 | 705 | | | | | | |
| 1261 | 4761 | 1190622 | 1188388 | 2235 | pir: S57636 | Catharanthus roseus metE | 45.2 | 72.2 | 774 | 5-methyltetrahydropteroyltriglutamate—homocysteine S-methyltransferase |
| 1262 | 4762 | 1191087 | 1191542 | 456 | gsp: Y29930 | Nocardia asteroides strain KGB1 | 55.2 | 79.5 | 444 | thiophene biotransformation protein |
| 1263 | 4763 | 1192410 | 1193807 | 1398 | | | | | | |
| 1264 | 4764 | 1193867 | 1194190 | 324 | | | | | | |
| 1265 | 4765 | 1194165 | 1195109 | 945 | | | | | | |
| 1266 | 4766 | 1195916 | 1195125 | 792 | | | | | | |
| 1267 | 4767 | 1195974 | 1197620 | 1647 | | | | | | |
| 1268 | 4768 | 1197624 | 1197815 | 192 | | | | | | |
| 1269 | 4769 | 1199543 | 1197990 | 1554 | sp: CYDC_ECOLI | Escherichia coli K12 MG1655 cydC | 28.7 | 63.5 | 526 | ABC transporter |
| 1270 | 4770 | 1201075 | 1199543 | 1533 | sp: CYDD_ECOLI | Escherichia coli K12 MG1655 cydD | 29.4 | 58.4 | 551 | ABC transporter |
| 1271 | 4771 | 1202088 | 1201090 | 999 | gp: AB035086_2 | Corynebacterium glutamicum (Brevibacterium lactofermentum) cydB | 92.0 | 93.0 | 333 | cytochrome bd-type menaquinol oxidase subunit II |
| 1272 | 4772 | 1203632 | 1202094 | 1539 | gp: AB035086_1 | Corynebacterium glutamicum (Brevibacterium lactofermentum) cydA | 99.6 | 99.0 | 512 | cytochrome bd-type menaquinol oxidase subunit I |
| 1273 | 4773 | 1206180 | 1203916 | 2265 | sp: YEJH_ECOLI | Escherichia coli K12 MG1655 yejH | 26.4 | 55.0 | 402 | helicase |
| 1274 | 4774 | 1206316 | 1206657 | 342 | | | | | | |
| 1275 | 4775 | 1207223 | 1206831 | 393 | sp: MUTT_PROVU | Proteus vulgaris mutT | 36.9 | 65.6 | 98 | mutator mutT protein (7,8-dihydro-8-oxoguanine-triphosphatase)(8-oxo-dGTPase)(dGTP pyrophosphohydrolase) |
| 1276 | 4776 | 1207374 | 1208138 | 765 | sp: PROY_SALTY | Salmonella typhimurium proY | 51.3 | 85.0 | 433 | proline-specific permease |
| 1277 | 4777 | 1209615 | 1208212 | 1404 | sp: DEAD_KLEPN | Klebsiella pneumoniae CG43 DEAD box ATP-dependent RNA helicase deaD | 48.1 | 74.3 | 643 | DEAD box ATP-dependent RNA helicase |
| 1278 | 4778 | 1209934 | 1212129 | 2196 | | | | | | |
| 1279 | 4779 | 1213115 | 1212429 | 687 | prf: 2323363BT | Mycobacterium leprae B1308_C2_181 | 24.7 | 47.4 | 247 | bacterial regulatory protein, tetR family |
| 1280 | 4780 | 1213269 | 1214858 | 1590 | sp: PCPB_FLAS3 | Sphingomonas flava pcpB | 24.5 | 47.7 | 595 | pentachlorophenol 4-monooxygenase |
| 1281 | 4781 | 1214871 | 1215938 | 1068 | sp: CLCE_PSESB | Pseudomonas sp. B13 clcE | 40.4 | 72.0 | 354 | maleylacetate reductase |
| 1282 | 4782 | 1215952 | 1216836 | 885 | sp: CATA_ACICA | Acinetobacter calcoaceticus catA | 30.6 | 59.4 | 278 | catechol 1,2-dioxygenase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1283 | 4783 | 1217374 | 1216904 | 471 | pir: A70672 | *Mycobacterium tuberculosis* H37Rv Rv2972c | 31.9 | 58.4 | 185 | hypothetical protein |
| 1284 | 4784 | 1217982 | 1217443 | 540 | sp: SNF2_YEAST | *Saccharomyces cerevisiae* SNF2 | 24.9 | 55.4 | 878 | transcriptional regulator |
| 1285 | 4785 | 1219895 | 1222996 | 3102 | | | | | | |
| 1286 | 4786 | 1222905 | 1221841 | 1065 | gp: SCO007731_6 | *Streptomyces coelicolor* A3(2) orfZ | 29.6 | 56.2 | 203 | hypothetical protein |
| 1287 | 4787 | 1222986 | 1223843 | 858 | | | | | | |
| 1288 | 4788 | 1223887 | 1225059 | 1173 | pir: E70755 | *Mycobacterium tuberculosis* H37Rv Rv1277 | 39.2 | 67.3 | 395 | phosphoesterase |
| 1289 | 4789 | 1225066 | 1227693 | 2628 | sp: Y084_MYCTU | *Mycobacterium tuberculosis* H37Rv Rv1278 | 29.7 | 59.6 | 915 | hypothetical protein |
| 1290 | 4790 | 1227587 | 1227282 | 306 | | | | | | |
| 1291 | 4791 | 1227657 | 1227340 | 318 | | | | | | |
| 1292 | 4792 | 1227863 | 1228636 | 774 | gp: AB029896_1 | Petroleum-degrading bacterium HD-1 hde | 37.3 | 64.6 | 220 | esterase or lipase |
| 1293 | 4793 | 1228718 | 1229095 | 378 | | | | | | |
| 1294 | 4794 | 1229150 | 1229935 | 786 | sp: ATOE_ECOLI | *Streptomyces coelicolor* SC1C2.14c atoE | 37.7 | 69.7 | 122 | short-chain fatty acids transporter |
| 1295 | 4795 | 1229716 | 1229180 | 537 | sp: PECS_ERWCH | *Erwinia chrysanthemi* recS | 24.7 | 56.6 | 166 | regulatory protein |
| 1296 | 4796 | 1229995 | 1230480 | 486 | | | | | | |
| 1297 | 4797 | 1230610 | 1230831 | 222 | | | | | | |
| 1298 | 4798 | 1231432 | 1230914 | 519 | | | | | | |
| 1299 | 4799 | 1231730 | 1232479 | 750 | sp: FNR_ECOLI | *Escherichia coli* K12 MG1655 fnr | 25.0 | 57.9 | 228 | fumarate (and nitrate) reduction regulatory protein |
| 1300 | 4800 | 1232603 | 1232836 | 234 | sp: MERP_SHEPU | *Shewanella putrefaciens* merP | 33.3 | 66.7 | 81 | mercuric transort protein periplasmic component precursor |
| 1301 | 4801 | 1233007 | 1234881 | 1875 | sp: ATZN_ECOLI | *Escherichia coli* K12 MG1655 atzN | 38.0 | 70.6 | 605 | zinc-transporting ATPase Zn(II)-translocating P-type ATPase |
| 1302 | 4802 | 1234983 | 1235612 | 630 | sp: RELA_VIBSS | *Vibrio* sp. S14 relA | 32.9 | 58.4 | 137 | GTP pyrophosphokinase (ATP: GTP 3'-pyrophosphotransferase) (ppGpp synthetase I) |
| 1303 | 4803 | 1238125 | 1236545 | 1581 | gsp: R80504 | *Streptomyces lividans* tap | 26.6 | 49.3 | 601 | tripeptidyl aminopeptidase |
| 1304 | 4804 | 1242156 | 1241554 | 603 | | | | | | |
| 1305 | 4805 | 1242275 | 1242156 | 120 | | | | | | |
| 1306 | 4806 | 1243621 | 1243728 | 108 | GSP: P61449 | *Corynebacterium glutamicum* | 95.0 | 98.0 | 24 | homoserine dehydrogenase |
| 1307 | 4807 | 1243942 | 1245201 | 1260 | | | | | | |
| 1308 | 4808 | 1245532 | 1244843 | 690 | | | | | | |
| 1309 | 4809 | 1246496 | 1245720 | 777 | sp: NARI_BACSU | *Bacillus subtilis* narI | 45.0 | 69.6 | 220 | nitrate reductase gamma chain |
| 1310 | 4810 | 1247239 | 1246508 | 732 | sp: NARJ_BACSU | *Bacillus subtilis* narJ | 30.3 | 63.4 | 175 | nitrate reductase delta chain |
| 1311 | 4811 | 1248791 | 1247199 | 1593 | sp: NARH_BACSU | *Bacillus subtilis* narH | 56.6 | 83.4 | 505 | nitrate reductase beta chain |
| 1312 | 4812 | 1249851 | 1250444 | 594 | PIR: D72603 | *Aeropyrum pernix* K1 APE1291 | 36.0 | 48.0 | 137 | hypothetical protein |
| 1313 | 4813 | 1251545 | 1251817 | 273 | PIR: B72603 | *Aeropyrum pernix* K1 APE1289 | 36.0 | 55.0 | 83 | hypothetical protein |
| 1314 | 4814 | 1252537 | 1248794 | 3744 | sp: NARG_BACSU | *Bacillus subtilis* narG | 46.9 | 73.8 | 1271 | nitrate reductase alpha chain |
| 1315 | 4815 | 1253906 | 1252557 | 1350 | sp: NARK_ECOLI | *Escherichia coli* K12 narK | 32.8 | 67.9 | 461 | nitrate extrusion protein |
| 1316 | 4816 | 1254146 | 1254634 | 489 | sp: CNX1_ARATH | *Arabidopsis thaliana* CV cnx1 | 32.5 | 65.0 | 157 | molybdopterin biosynthesis cnx1 protein (molybdenum cofactor biosynthesis enzyme cnx1) |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1317 | 4817 | 1256602 | 1254737 | 1866 | sp: PRTS_SERMA | Serratia marcescens strain IFO-3046 prtS | 21.1 | 45.9 | 738 | extracellular serine protease precurosor |
| 1318 | 4818 | 1257067 | 1257750 | 684 | sp: Y0D3_MYCTU | Mycobacterium tuberculosis H37Rv Rv1841c | 30.8 | 62.6 | 334 | hypothetical membrane protein |
| 1319 | 4819 | 1257858 | 1256851 | 1008 | | | | | | |
| 1320 | 4820 | 1259265 | 1257865 | 1401 | sp: Y0D2_MYCTU | Mycobacterium tuberculosis H37Rv Rv1842c | 31.6 | 60.2 | 472 | hypothetical membrane protein |
| 1321 | 4821 | 1259989 | 1259429 | 561 | gp: PPU242952_2 | Pseudomonas putida mobA | 27.5 | 52.3 | 178 | molybdopterin guanine dinucleotide synthase |
| 1322 | 4822 | 1261201 | 1259993 | 1209 | sp: MOEA_ECOLI | Mycobacterium tuberculosis H37Rv Rv0438c moeA | 32.8 | 58.2 | 366 | molybdoptein biosynthesis protein |
| 1323 | 4823 | 1262818 | 1261688 | 1131 | sp: CNX2_ARATH | Arabidopsis thaliana cnx2 | 51.4 | 73.7 | 354 | molybdopterin biosynthsisi protein Moybdenume (mosybdenum cofastor biosynthesis enzyme) |
| 1324 | 4824 | 1264610 | 1262886 | 1725 | sp: ALKK_PSEOL | Pseudomonas oleovorans | 36.7 | 65.7 | 572 | edium-chain fatty acid—CoA ligase |
| 1325 | 4825 | 1265142 | 1267427 | 2286 | sp: RHO_MICLU | Micrococcus luteus rho | 50.7 | 73.8 | 753 | Rho factor |
| 1326 | 4826 | 1265665 | 1266267 | 603 | | | | | | |
| 1327 | 4827 | 1266306 | 1265611 | 696 | | | | | | |
| 1328 | 4828 | 1266449 | 1265427 | 1023 | | | | | | |
| 1329 | 4829 | 1267430 | 1268503 | 1074 | sp: RF1_ECOLI | Escherichia coli K12 RF-1 | 41.9 | 71.9 | 363 | peptide chain release factor 1 |
| 1330 | 4830 | 1268507 | 1269343 | 837 | sp: HEMK_ECOLI | Escherichia coli K12 | 31.1 | 57.9 | 280 | protoporphyrinogen oxidase |
| 1331 | 4831 | 1269040 | 1268267 | 774 | | | | | | |
| 1332 | 4832 | 1269396 | 1270043 | 648 | sp: YD01_MYCTU | Mycobacterium tuberculosis H37Rv Rv1301 | 62.3 | 86.0 | 215 | hypothetical protein |
| 1333 | 4833 | 1270047 | 1271192 | 1146 | sp: RFE_ECOLI | Escherichia coli K12 rfe | 31.1 | 58.4 | 322 | undecaprenyl-phosphate alpha-N-acetylglucosaminyltransferase |
| 1334 | 4834 | 1271213 | 1271698 | 486 | | | | | | |
| 1335 | 4835 | 1271871 | 1272119 | 249 | GPU: AB046112_1 | Corynebacterium glutamicum atpI | 98.0 | 99.0 | 80 | hypothetical protein |
| 1336 | 4836 | 1272340 | 1273149 | 810 | sp: ATP6_ECOLI | Escherichia coli K12 atpB | 24.1 | 56.7 | 245 | ATP synthase chain a (protein 6) |
| 1337 | 4837 | 1273286 | 1273525 | 240 | sp: ATPL_STRLI | Streptomyces lividans atpL | 54.9 | 85.9 | 71 | H+-transporting ATP synthase lipid-binding protein. ATP synthase C chane |
| 1338 | 4838 | 1273559 | 1274122 | 564 | sp: ATPF_STRLI | Streptomyces lividans atpF | 27.8 | 66.9 | 151 | H+-transporting ATP synthase chain b |
| 1339 | 4839 | 1274131 | 1274943 | 813 | sp: ATPD_STRLI | Streptomyces lividans atpD | 34.3 | 67.2 | 274 | H+-transporting ATP synthase delta chain |
| 1340 | 4840 | 1274975 | 1276648 | 1674 | sp: ATPA_STRLI | Streptomyces lividans atpA | 66.9 | 88.4 | 516 | H+-transporting ATP synthase alpha chain |
| 1341 | 4841 | 1276708 | 1277682 | 975 | sp: ATPG_STRLI | Streptomyces lividans atpG | 46.3 | 76.6 | 320 | H+-transporting ATP synthase gamma chain |
| 1342 | 4842 | 1277688 | 1279136 | 1449 | sp: ATPB_CORGL | Corynebacterium glutamicum AS019 atpB | 99.8 | 100.0 | 483 | H+-transporting ATP synthase beta chain |
| 1343 | 4843 | 1279151 | 1279522 | 372 | sp: ATPE_STRLI | Streptomyces lividans atpE | 41.0 | 73.0 | 122 | H+-transporting ATP synthase epsilon chain |
| 1344 | 4844 | 1279770 | 1280240 | 471 | sp: Y02W_MYCTU | Mycobacterium tuberculosis H37Rv Rv1312 | 38.6 | 67.4 | 132 | hypothetical protein |
| 1345 | 4845 | 1280270 | 1280959 | 690 | sp: Y036_MYCTU | Mycobacterium tuberculosis H37Rv Rv1321 | 70.0 | 85.7 | 230 | hypothetical protein |
| 1346 | 4846 | 1280967 | 1281251 | 285 | GP: SC26G5_35 | Streptomyces coelicolor A3(2) | 45.0 | 56.0 | 95 | putative ATP/GTP-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1347 | 4847 | 1281714 | 1281262 | 453 | sp: YQJC_BACSU | Bacillus subtilis yqjC | 35.8 | 68.7 | 134 | hypothetical protein |
| 1348 | 4848 | 1281794 | 1282105 | 312 | sp: YC20_MYCTU | Mycobacterium tuberculosis H37Rv Rv1898 | 54.5 | 79.2 | 101 | hypothetical protein |
| 1349 | 4849 | 1282194 | 1283114 | 921 | sp: YD24_MYCTU | Mycobacterium tuberculosis H37Rv Rv1324 | 37.9 | 71.4 | 301 | thioredoxin |
| 1350 | 4850 | 1283324 | 1284466 | 1143 | gp: ECO237695_3 | Escherichia coli K12 ssuD | 50.3 | 74.3 | 366 | FMNH2-dependent aliphatic sulfonate monooxygenase |
| 1351 | 4851 | 1284517 | 1285284 | 768 | sp: SSUC_ECOLI | Escherichia coli K12 ssuC | 40.8 | 75.8 | 240 | alphatic sulfonates transport permease protein |
| 1352 | 4852 | 1285302 | 1286030 | 729 | sp: SSUB_ECOLI | Escherichia coli K12 ssuB | 50.4 | 72.8 | 228 | alphatic sulfonates transport permease protein |
| 1353 | 4853 | 1286043 | 1286999 | 957 | sp: SSUA_ECOLI | Escherichia coli K12 ssuA | 35.1 | 62.1 | 311 | sulfonate binding protein precursor |
| 1354 | 4854 | 1289473 | 1287281 | 2193 | sp: GLGB_ECOLI | Mycobacterium tuberculosis H37Rv Rv1326c glgB | 46.1 | 72.7 | 710 | 1,4-alpha-glucan branching enzyme (glycogen branching enzyme) |
| 1355 | 4855 | 1291007 | 1289514 | 1494 | sp: AMY3_DICTH | Dictyoglomus thermophilum amyC | 22.9 | 50.5 | 467 | alpha-amylase |
| 1356 | 4856 | 1291026 | 1291373 | 348 | | | | | | |
| 1357 | 4857 | 1291699 | 1292577 | 879 | sp: FEPC_ECOLI | Escherichia coli K12 fepC | 31.8 | 87.6 | 211 | ferric enterobactin transport ATP-binding protein or ABC transport ATP-binding protein |
| 1358 | 4858 | 1293222 | 1294025 | 804 | pir: C70860 | Mycobacterium tuberculosis H37Rv Rv3040c | 39.6 | 68.5 | 260 | hypothetical protein |
| 1359 | 4859 | 1294151 | 1295206 | 1056 | pir: H70859 | Mycobacterium tuberculosis H37Rv Rv3037c | 43.1 | 70.0 | 367 | hypothetical protein |
| 1360 | 4860 | 1295047 | 1294436 | 612 | | | | | | |
| 1361 | 4861 | 1295435 | 1296220 | 786 | sp: FIXA_RHIME | Rhizobium meliloti fixA | 31.2 | 64.8 | 244 | electron transfer flavoprotein beta-subunit |
| 1362 | 4862 | 1296253 | 1297203 | 951 | sp: FIXB_RHIME | Rhizobium meliloti fixB | 33.1 | 61.8 | 335 | electron transfer flavoprotein alpha subunit for various dehydrogenases |
| 1363 | 4863 | 1296479 | 1297093 | 615 | sp: NIFS_AZOVI | Azotobacter vinelandii nifS | 35.2 | 67.7 | 375 | nitrogenase cofactor sythesis protein |
| 1364 | 4864 | 1297212 | 1298339 | 1128 | sp: Y4ME_RHISN | Rhizobium sp. NGR234 plasmid pNGR234a y4mE | 29.5 | 55.7 | 397 | hypothetical protein |
| 1365 | 4865 | 1298653 | 1298342 | 312 | | | | | | |
| 1366 | 4866 | 1300145 | 1299000 | 1146 | sp: Y4MF_RHISN | Rhizobium sp. NGR234 plasmid pNGR234a Y4mF | 47.5 | 76.3 | 59 | hypothetical protein |
| 1367 | 4867 | 1300369 | 1300145 | 225 | sp: YHBS_ECOLI | Escherichia coli K12 MG1655 | 34.8 | 55.3 | 181 | transcriptional regulator |
| 1368 | 4868 | 1300552 | 1301055 | 504 | | | | | | acetyltransferase |
| 1369 | 4869 | 1301929 | 1300988 | 942 | | | | | | |
| 1370 | 4870 | 1303123 | 1301975 | 1149 | | | | | | |
| 1371 | 4871 | 1303299 | 1303694 | 396 | | | | | | |
| 1372 | 4872 | 1303829 | 1304923 | 1095 | pir: C70858 | Mycobacterium tuberculosis H37Rv Rv3024c | 61.8 | 80.9 | 361 | tRNA (5-methylaminomethyl-2-thiouridylate)-methyltransferase |
| 1373 | 4873 | 1304536 | 1303883 | 654 | pir: B70857 | Mycobacterium tuberculosis H37Rv Rv3015c | 33.7 | 66.0 | 332 | hypothetical protein |
| 1374 | 4874 | 1304932 | 1305921 | 990 | | | | | | |
| 1375 | 4875 | 1307384 | 1305924 | 1461 | sp: TCMA_STRGA | Streptomyces glaucescens tcmA | 30.2 | 65.8 | 500 | tetracenomycin C resistance and export protin |
| 1376 | 4876 | 1308196 | 1307462 | 735 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1377 | 4877 | 1308330 | 1310369 | 2040 | sp: DNLJ_RHOMR | Rhodothermus marinus dnlJ | 42.8 | 70.6 | 677 | DNA ligase (polydeoxyribonucleotide synthase [NAD+] |
| 1378 | 4878 | 1311097 | 1310435 | 663 | pir: H70856 | Mycobacterium tuberculosis H37Rv Rv3013 | 40.0 | 70.9 | 220 | hypothetical protein |
| 1379 | 4879 | 1311320 | 1311616 | 297 | sp: GATC_STRCO | Streptomyces coelicolor A3(2) gatC | 53.0 | 64.0 | 97 | glutamyl-tRNA(Gln) amidotransferase subunit C |
| 1380 | 4880 | 1311625 | 1313115 | 1491 | sp: GATA_MYCTU | Mycobacterium tuberculosis H37Rv gatA | 74.0 | 83.0 | 484 | glutamyl-tRNA(Gln) amidotransferase subunit A |
| 1381 | 4881 | 1313270 | 1314118 | 849 | sp: VIUB_VIBVU | Vibrio vulnificus viuB | 28.1 | 54.0 | 263 | vibriobactin utilization protein/iron-chelator utilization protein |
| 1382 | 4882 | 1314775 | 1314470 | 306 | gp: SCE6_24 | Streptomyces coelicolor A3(2) SCE6.24 | 46.9 | 79.2 | 96 | hypothetical membrane protein |
| 1383 | 4883 | 1315013 | 1316083 | 1071 | sp: PFP_AMYME | Amycolatopsis methanolica pfp | 54.8 | 77.9 | 358 | pyrophosphate—fructose 6-phosphate 1-phosphotransferase |
| 1384 | 4884 | 1315954 | 1315325 | 630 | | | | | | |
| 1385 | 4885 | 1316338 | 1317444 | 1107 | sp: CCPA_BACME | Bacillus megaterium ccpA | 31.4 | 31.4 | 328 | glucose-resistance amylase regulator (catabolite control protein) |
| 1386 | 4886 | 1317434 | 1319005 | 1572 | sp: RBSA_ECOLI | Escherichia coli K12 rbsA | 44.7 | 76.2 | 499 | ripose transport ATP-binding protein |
| 1387 | 4887 | 1319005 | 1319976 | 972 | sp: RBSC_ECOLI | Escherichia coli K12 MG1655 rbsC | 45.6 | 76.9 | 329 | high affinity ribose transport protein |
| 1388 | 4888 | 1320001 | 1320942 | 942 | sp: RBSB_ECOLI | Escherichia coli K12 MG1655 rbsB | 45.9 | 77.7 | 305 | periplasmic ribose-binding protein |
| 1389 | 4889 | 1320952 | 1321320 | 369 | sp: RBSD_ECOLI | Escherichia coli K12 MG1655 rbsD | 41.7 | 68.4 | 139 | high affinity ribose transport protein |
| 1390 | 4890 | 1321476 | 1322111 | 636 | sp: YIW2_YEAST | Saccharomyces cerevisiae YIR042c | 31.0 | 58.0 | 200 | hypothetical protein |
| 1391 | 4891 | 1322393 | 1323406 | 1014 | gp: SCF34_13 | Streptomyces coelicolor SCF34.13c | 31.4 | 60.2 | 354 | iron-siderophore binding lipoprotein |
| 1392 | 4892 | 1323533 | 1324537 | 1005 | sp: NTCL_RAT | Rattus norvegicus (Rat) NTCl | 35.8 | 61.9 | 268 | Na-dependent bile acid transporter |
| 1393 | 4893 | 1324778 | 1326256 | 1479 | gsp: W61467 | Staphylococcus aureus WHU 29 ratB | 43.1 | 71.8 | 485 | RNA-dependent amidotransferase B |
| 1394 | 4894 | 1326378 | 1327049 | 672 | sp: F4RE_METJA | Methanococcus jannaschii MJ1501 f4re | 32.6 | 61.1 | 172 | putative F420-dependent NADH reductase |
| 1395 | 4895 | 1330967 | 1329891 | 1077 | sp: YQJG_ECOLI | Escherichia coli K12 yqjG | 39.8 | 66.9 | 317 | hypothetical protein |
| 1396 | 4896 | 1331102 | 1331875 | 774 | pir: A70672 | Mycobacterium tuberculosis H37Rv Rv2972c | 39.3 | 62.4 | 234 | hypothetical protein |
| 1397 | 4897 | 1331953 | 1333008 | 1056 | pir: H70855 | Mycobacterium tuberculosis H37Rv Rv3005c | 27.4 | 52.6 | 325 | hypothetical membrane protein |
| 1398 | 4898 | 1333424 | 1333188 | 237 | | | | | | |
| 1399 | 4899 | 1335280 | 1333442 | 1839 | gp: AJ012293_1 | Corynebacterium glutamicum ATCC 13032 IlvD | 99.2 | 99.4 | 613 | dihydroxy-acid dehydratase |
| 1400 | 4900 | 1335975 | 1335412 | 564 | pir: G70855 | Mycobacterium tuberculosis H37Rv Rv3004 | 33.3 | 68.6 | 105 | hypothetical protein |
| 1401 | 4901 | 1337567 | 1336095 | 1473 | sp: YILV_CORGL | Corynebacterium glutamicum ATCC 13032 yilV | 100.0 | 100.0 | 62 | hypothetical membrane protein |
| 1402 | 4902 | 1338609 | 1338379 | 231 | GP: SSU18930_263 | Sulfolobus solfataricus | 45.0 | 55.0 | 66 | hypothetical protein |
| 1403 | 4903 | 1342072 | 1342677 | 606 | | | | | | |
| 1404 | 4904 | 1342457 | 1341960 | 498 | sp: NRTD_SYNP7 | Synechococcus sp. nrtD | 50.9 | 80.8 | 167 | nitrate transport ATP-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1405 | 4905 | 1342727 | 1342461 | 267 | sp: MALK_ENTAE | *Enterobacter aerogenes* (*Aerobacter aerogenes*) malK | 46.0 | 78.2 | 87 | maltose/maltodextrin transport ATP-binding protein |
| 1406 | 4906 | 1343675 | 1342794 | 882 | sp: NRTA_ANASP | *Anabaena* sp. strain PCC 7120 nrtA | 28.1 | 56.8 | 324 | nitrate transporter protein |
| 1407 | 4907 | 1344018 | 1344464 | 447 | | | | | | |
| 1408 | 4908 | 1344440 | 1344808 | 369 | | | | | | |
| 1409 | 4909 | 1344935 | 1345420 | 486 | sp: DIM6_STRCO | *Streptomyces coelicolor* | 39.4 | 73.2 | 142 | actinorhodin polyketide dimerase |
| 1410 | 4910 | 1345486 | 1346439 | 954 | sp: CZCD_ALCEU | *Ralstonia eutropha* czcD | 39.1 | 72.7 | 304 | cobalt-zinc-cadmium resistance protein |
| 1411 | 4911 | 1345487 | 1345335 | 153 | | | | | | |
| 1412 | 4912 | 1346331 | 1345642 | 690 | | | | | | |
| 1413 | 4913 | 1346458 | 1348272 | 1815 | sp: V686_METJA | *Methanococcus jannaschii* | 22.9 | 53.7 | 642 | hypothetical protein |
| 1414 | 4914 | 1348334 | 1350076 | 1743 | gsp: Y22646 | *Brevibacterium flavum* serA | 99.8 | 100.0 | 530 | D-3-phosphoglycerate dehydrogenase |
| 1415 | 4915 | 1350855 | 1352444 | 1590 | | | | | | |
| 1416 | 4916 | 1352053 | 1351727 | 327 | SP: YEN1_SCHPO | *Schizosaccharomyces pombe* SPAC11G7.01 | 29.0 | 52.0 | 105 | hypothetical serine-rich protein |
| 1417 | 4917 | 1352585 | 1353451 | 867 | | | | | | |
| 1418 | 4918 | 1355601 | 1354540 | 1062 | | | | | | |
| 1419 | 4919 | 1355689 | 1357554 | 1866 | pir: T03476 | *Rhodobacter capsulatus* strain SB1003 | 32.9 | 63.1 | 620 | hypothetical protein |
| 1420 | 4920 | 1356452 | 1356853 | 402 | | | | | | |
| 1421 | 4921 | 1357557 | 1358210 | 654 | | | | | | |
| 1422 | 4922 | 1358259 | 1359062 | 804 | sp: HPCE_ECOLI | *Escherichia coli* C hpcE | 33.3 | 59.2 | 228 | homoprotocatechuate catabolism bifunctional isomerase/decarboxylase [includes: 2-hydroxyhepta-2,4-diene-1,7-dioate isomerase(hhdd isomerase); 5-carboxymethyl-2-oxo-hex-3-ene-1,7-dioate decarboxylase(opet decarboxylase)] |
| 1423 | 4923 | 1359052 | 1359669 | 618 | sp: UBIG_ECOLI | *Escherichia coli* K12 | 23.4 | 55.7 | 192 | methyltransferase or 3-demethylubiquinone-9 3-O-methyltransferase |
| 1424 | 4924 | 1361295 | 1360168 | 1128 | sp: DHBC_BACSU | *Bacillus subtilis* dhbC | 38.0 | 70.4 | 371 | isochorismate synthase |
| 1425 | 4925 | 1361361 | 1362848 | 1488 | sp: SYE_BACSU | *Bacillus subtilis* gltX | 37.3 | 69.7 | 485 | glutamyl-tRNA synthetase |
| 1426 | 4926 | 1363138 | 1362926 | 213 | gp: SCJ33_10 | *Streptomyces coelicolor* A3(2) | 77.0 | 90.0 | 67 | transcriptional regulator |
| 1427 | 4927 | 1363657 | 1363142 | 516 | | | | | | |
| 1428 | 4928 | 1364253 | 1363732 | 522 | | | | | | |
| 1429 | 4929 | 1364915 | 1365256 | 342 | | | | | | |
| 1430 | 4930 | 1364960 | 1364340 | 621 | | | | | | |
| 1431 | 4931 | 1365180 | 1364878 | 303 | | | | | | |
| 1432 | 4932 | 1365396 | 1365217 | 180 | | | | | | |
| 1433 | 4933 | 1365808 | 1366137 | 330 | | | | | | |
| 1434 | 4934 | 1367293 | 1367505 | 213 | | | | | | |
| 1435 | 4935 | 1368070 | 1367888 | 183 | | | | | | |
| 1436 | 4936 | 1368078 | 1368395 | 318 | | | | | | |
| 1437 | 4937 | 1368400 | 1369551 | 1152 | | | | | | |
| 1438 | 4938 | 1369551 | 1369874 | 324 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1439 | 4939 | 1371637 | 1369877 | 1761 | sp: THIC_BACSU | Bacillus subtilis thiA or thiC | 65.1 | 81.0 | 599 | thiamin biosynthesis protein |
| 1440 | 4940 | 1372326 | 1371979 | 348 | | | | | | |
| 1441 | 4941 | 1372601 | 1373131 | 531 | | | | | | |
| 1442 | 4942 | 1373798 | 1373929 | 132 | GSP: Y37857 | Chlamydia trachomatis | 61.0 | 74.0 | 44 | lipoprotein |
| 1443 | 4943 | 1374556 | 1375491 | 936 | | | | | | |
| 1444 | 4944 | 1375776 | 1373350 | 2427 | sp: PHS1_RAT | Rattus norvegicus (Rat) | 44.2 | 74.0 | 797 | glycogen phosphorylase |
| 1445 | 4945 | 1375987 | 1375805 | 183 | | | | | | |
| 1446 | 4946 | 1376088 | 1375933 | 156 | | | | | | |
| 1447 | 4947 | 1377555 | 1376149 | 1407 | sp: YRKH_BACSU | Bacillus subtilis yrkH | 25.4 | 52.8 | 299 | hypothetical protein |
| 1448 | 4948 | 1378415 | 1377666 | 750 | sp: Y441_METJA | Methanococcus jannaschii Y441 | 25.4 | 64.8 | 256 | hypothetical membrane protein |
| 1449 | 4949 | 1378942 | 1378466 | 477 | | | | | | |
| 1450 | 4950 | 1379003 | 1379566 | 564 | sp: SPOT_ECOLI | Escherichia coli K12 spoT | 29.8 | 60.1 | 178 | guanosine 3',5'-bis(diphosphate) 3'-pyrophosphatase |
| 1451 | 4951 | 1380259 | 1379555 | 705 | sp: ICLR_ECOLI | Escherichia coli K12 iclR | 26.1 | 60.7 | 257 | acetate repressor protein |
| 1452 | 4952 | 1380440 | 1381882 | 1443 | sp: LEU2_ACTTI | Actinoplanes teichomyceticus leu2 | 68.1 | 87.5 | 473 | 3-isopropylmalate dehydratase large subunit |
| 1453 | 4953 | 1381902 | 1382492 | 591 | sp: LEUD_SALTY | Salmonella typhimurium | 67.7 | 89.2 | 195 | 3-isopropylmalate dehydratase small subunit |
| 1454 | 4954 | 1382819 | 1382502 | 318 | | | | | | |
| 1455 | 4955 | 1383798 | 1382845 | 954 | gp: MLCB637_35 | Mycobacterium tuberculosis H37Rv MLCB637.35c | 45.9 | 71.4 | 294 | mutator mutT protein ((7,8-dihydro-8-oxoguanine-triphosphatase)(8-oxo-dGTPase)(dGTP pyrophosphohydrolase) |
| 1456 | 4956 | 1383930 | 1384085 | 156 | | | | | | |
| 1457 | 4957 | 1384130 | 1385125 | 996 | sp: GPDA_BACSU | Bacillus subtilis gpdA | 45.0 | 72.2 | 331 | NAD(P)H-dependent dihydroxyacetone phosphate reductase |
| 1458 | 4958 | 1385153 | 1386232 | 1080 | sp: DDLA_ECOLI | Escherichia coli K12 MG1655 ddlA | 40.4 | 67.4 | 374 | D-alanine-D-alanine ligase |
| 1459 | 4959 | 1387270 | 1386293 | 978 | sp: THIL_ECOLI | Escherichia coli K12 thiL | 32.2 | 57.6 | 335 | thiamin-phosphate kinase |
| 1460 | 4960 | 1387332 | 1388324 | 993 | sp: UNG_MOUSE | Mus musculus ung | 38.8 | 59.6 | 245 | uracil-DNA glycosylase precursor |
| 1461 | 4961 | 1388312 | 1389073 | 762 | sp: Y369_MYCGE | Mycoplasma genitalium (SGC3) MG369 | 23.1 | 56.3 | 568 | hypothetical protein |
| 1462 | 4962 | 1389208 | 1390788 | 1581 | | | | | | |
| 1463 | 4963 | 1390796 | 1392916 | 2121 | sp: RECG_ECOLI | Escherichia coli K12 recG | 35.4 | 60.0 | 693 | ATP-dependent DNA helicase |
| 1464 | 4964 | 1391961 | 1391638 | 324 | GSP: Y75303 | Neisseria meningitidis | 31.0 | 48.0 | 108 | polypeptides predicted to be useful antigens for vaccines and diagnostics |
| 1465 | 4965 | 1392939 | 1393151 | 213 | sp: BCCP_PROFR | Propionibacterium freudenreichii subsp. Shermanii | 38.8 | 67.2 | 67 | biotin carboxyl carrier protein |
| 1466 | 4966 | 1393154 | 1393735 | 582 | sp: YHHF_ECOLI | Escherichia coli K12 yhhF | 37.1 | 63.5 | 167 | methylase |
| 1467 | 4967 | 1393742 | 1394221 | 480 | sp: KDTB_ECOLI | Escherichia coli K12 MG1655 kdtB | 42.6 | 78.7 | 155 | lipopolysaccharide core biosynthesis protein |
| 1468 | 4968 | 1394854 | 1395933 | 1080 | | | | | | |
| 1469 | 4969 | 1394894 | 1395097 | 204 | GSP: Y75358 | Neisseria gonorrhoeae | 67.0 | 74.0 | 65 | Neisserial polypeptides predicted to be useful antigens for vaccines and diagnostics |
| 1470 | 4970 | 1395549 | 1394800 | 750 | sp: GLNQ_BACST | Bacillus stearothermophilus glnQ | 56.4 | 78.6 | 252 | ABC transporter or glutamine ABC transporter, ATP-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1471 | 4971 | 1396410 | 1395568 | 843 | sp: NOCM_AGRT5 | *Agrobacterium tumefaciens* nocM | 32.7 | 75.0 | 220 | nopaline transport protein |
| 1472 | 4972 | 1397421 | 1396561 | 861 | sp: GLNH_ECOLI | *Escherichia coli* K12 MG1655 glnH | 27.4 | 59.0 | 234 | glutamine-binding protein precursor |
| 1473 | 4973 | 1397662 | 1398468 | 807 | | | | | | |
| 1474 | 4974 | 1399534 | 1398557 | 978 | pir: H69160 | *Methanobacterium thermoautotrophicum* MTH465 | 28.6 | 60.3 | 322 | hypothetical membrane protein |
| 1475 | 4975 | 1400926 | 1401333 | 408 | | | | | | |
| 1476 | 4976 | 1400940 | 1400185 | 756 | sp: VINT_BPL54 | Bacteriophage L54a vinT | 26.9 | 52.5 | 223 | phage integrase |
| 1477 | 4977 | 1401333 | 1402076 | 744 | | | | | | |
| 1478 | 4978 | 1402272 | 1402703 | 432 | | | | | | |
| 1479 | 4979 | 1402874 | 1402368 | 507 | | | | | | |
| 1480 | 4980 | 1403128 | 1403991 | 864 | | | | | | |
| 1481 | 4981 | 1403997 | 1404215 | 219 | | | | | | |
| 1482 | 4982 | 1404885 | 1404694 | 192 | pir: S60890 | *Corynebacterium glutamicum* orf2 | 88.5 | 96.2 | 26 | insertion element (IS3 related) |
| 1483 | 4983 | 1406174 | 1405320 | 855 | | | | | | |
| 1484 | 4984 | 1407109 | 1406999 | 111 | PIR: S60890 | *Corynebacterium glutamicum* | 89.0 | 97.0 | 37 | hypothetical protein |
| 1485 | 4985 | 1407535 | 1407167 | 369 | | | | | | |
| 1486 | 4986 | 1407873 | 1407559 | 315 | | | | | | |
| 1487 | 4987 | 1409023 | 1408703 | 321 | | | | | | |
| 1488 | 4988 | 1409802 | 1409428 | 375 | | | | | | |
| 1489 | 4989 | 1411011 | 1410064 | 948 | | | | | | |
| 1490 | 4990 | 1411424 | 1411119 | 306 | | | | | | |
| 1491 | 4991 | 1412000 | 1411437 | 564 | | | | | | |
| 1492 | 4992 | 1412351 | 1412572 | 222 | | | | | | |
| 1493 | 4993 | 1412916 | 1412626 | 291 | | | | | | |
| 1494 | 4994 | 1413745 | 1416459 | 2715 | sp: DPO1_MYCTU | *Mycobacterium tuberculosis* polA | 56.3 | 80.8 | 896 | DNA polymerase I |
| 1495 | 4995 | 1417883 | 1416462 | 1422 | sp: CMCT_NOCLA | *Streptomyces lactamdurans* cmcT | 33.8 | 67.8 | 456 | cephamycin export protein |
| 1496 | 4996 | 1417962 | 1418870 | 909 | gp: SCJ9A_15 | *Streptomyces coelicolor* A3(2) SCJ9A.15c | 41.3 | 65.4 | 283 | DNA-binding protein |
| 1497 | 4997 | 1418876 | 1419748 | 873 | sp: MORA_PSEPU | *Pseudomonas putida* morA | 46.5 | 76.1 | 284 | morphine-6-dehydrogenase |
| 1498 | 4998 | 1420036 | 1419878 | 159 | sp: YAFE_ECOLI | *Streptomyces coelicolor* SCH5.13 yafE | 31.9 | 58.3 | 163 | hypothetical protein |
| 1499 | 4999 | 1420724 | 1420071 | 654 | | | | | | |
| 1500 | 5000 | 1421099 | 1422556 | 1458 | sp: RS1_ECOLI | *Escherichia coli* K12 rpsA | 39.5 | 71.4 | 451 | 30S ribosomal protein S1 |
| 1501 | 5001 | 1422571 | 1421096 | 1476 | | | | | | |
| 1502 | 5002 | 1425279 | 1425878 | 600 | sp: YACE_BRELA | *Brevibacterium lactofermentum* ATCC 13869 yacE | 80.5 | 93.9 | 195 | hypothetical protein |
| 1503 | 5003 | 1426257 | 1427354 | 1098 | | | | | | |
| 1504 | 5004 | 1427957 | 1427376 | 582 | | | | | | |
| 1505 | 5005 | 1428049 | 1427804 | 246 | | | | | | |
| 1506 | 5006 | 1428290 | 1429246 | 957 | | | | | | |
| 1507 | 5007 | 1429159 | 1428224 | 936 | sp: IUNH_CRIFA | *Crithidia fasciculata* iunH | 61.9 | 81.0 | 310 | inosine-uridine preferring nucleoside hypolase (purine nucleosidase) |
| 1508 | 5008 | 1430642 | 1429194 | 1449 | sp: QACA_STAAU | *Staphylococcus aureus* | 23.6 | 53.8 | 517 | aniseptic resistance protein |
| 1509 | 5009 | 1431579 | 1430659 | 921 | sp: RBSK_ECOLI | *Escherichia coli* K12 rbsK | 35.5 | 67.6 | 293 | ribose kinase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1510 | 5010 | 1432612 | 1431575 | 1038 | sp: ASCG_ECOLI | Escherichia coli K12 ascG | 30.0 | 65.6 | 337 | criptic asc operon repressor, transcription regulator |
| 1511 | 5011 | 1432750 | 1433547 | 798 | sp: UVRB_STRPN | Streptococcus pneumoniae plasmid pSB470 uvrB | 57.4 | 83.3 | 671 | excinuclease ABC subunit B |
| 1512 | 5012 | 1434105 | 1436201 | 2097 | | | | | | |
| 1513 | 5013 | 1436335 | 1436775 | 441 | sp: Y531_METJA | Methanococcus jannaschii MJ0531 | 33.6 | 59.2 | 152 | hypothetical protein |
| 1514 | 5014 | 1437249 | 1436869 | 381 | sp: YTFH_ECOLI | Escherichia coli K12 ytfH | 38.8 | 80.2 | 121 | hypothetical protein |
| 1515 | 5015 | 1437356 | 1438201 | 846 | sp: YTFG_ECOLI | Escherichia coli K12 ytfG | 53.8 | 77.1 | 279 | hypothetical protein |
| 1516 | 5016 | 1439343 | 1440026 | 684 | | | | | | |
| 1517 | 5017 | 1440560 | 1438212 | 2349 | pir: H70040 | Bacillus subtilis yvgS | 23.2 | 47.2 | 839 | hypothetical protein |
| 1518 | 5018 | 1441586 | 1440675 | 912 | gp: SC9H11_26 | Streptomyces coelicolor A3(2) SC9H11.26c | 32.7 | 68.0 | 150 | hypothetical protein |
| 1519 | 5019 | 1442392 | 1441793 | 600 | sp: YCBL_ECOLI | Escherichia coli K12 ycbL | 30.4 | 58.4 | 214 | hydrolase |
| 1520 | 5020 | 1442487 | 1445333 | 2847 | sp: UVRA_ECOLI | Escherichia coli K12 uvrA | 56.2 | 80.6 | 952 | excinuclease ABC subunit A |
| 1521 | 5021 | 1444115 | 1443810 | 306 | PIR: JQ0406 | Micrococcus luteus | 40.0 | 57.0 | 100 | hypothetical protein 1246 (uvrA region) |
| 1522 | 5022 | 1445393 | 1444944 | 450 | PIR: JQ0406 | Micrococcus luteus | 31.0 | 47.0 | 142 | hypothetical protein 1246 (uvrA region) |
| 1523 | 5023 | 1446158 | 1446874 | 717 | | | | | | |
| 1524 | 5024 | 1447446 | 1445323 | 2124 | | | | | | |
| 1525 | 5025 | 1447792 | 1448358 | 567 | sp: IF3_RHOSH | Rhodobacter sphaeroides infC | 52.5 | 78.2 | 179 | translation initiation factor IF-3 |
| 1526 | 5026 | 1448390 | 1448581 | 192 | sp: RL35_MYCFE | Mycoplasma fermentans | 41.7 | 76.7 | 60 | 50S ribosomal protein L35 |
| 1527 | 5027 | 1448645 | 1449025 | 381 | sp: RL20_PSESY | Pseudomonas syringae pv. syringae | 75.0 | 92.7 | 117 | 50S ribosomal protein L20 |
| 1528 | 5028 | 1449940 | 1449119 | 822 | | | | | | |
| 1529 | 5029 | 1450126 | 1450692 | 567 | | | | | | |
| 1530 | 5030 | 1450918 | 1451820 | 903 | sp: UGPA_ECOLI | Escherichia coli K12 MG1655 ugpA | 33.2 | 71.6 | 292 | sn-glycerol-3-phosphate transport system permease protein |
| 1531 | 5031 | 1451820 | 1452653 | 834 | sp: UGPE_ECOLI | Escherichia coli K12 MG1655 ugpE | 33.3 | 70.4 | 270 | sn-glycerol-3-phosphate transport system protein |
| 1532 | 5032 | 1452758 | 1454071 | 1314 | sp: UGPB_ECOLI | Escherichia coli K12 MG1655 ugpB | 26.6 | 57.6 | 436 | sn-glycerol-3-phosphate transport system permease proein |
| 1533 | 5033 | 1454115 | 1455338 | 1224 | sp: UGPC_ECOLI | Escherichia coli K12 MG1655 ugpC | 44.0 | 71.3 | 393 | sn-glycerol-3-phosphate transport ATP-binding protein |
| 1534 | 5034 | 1454350 | 1454102 | 249 | PIR: E72756 | Aeropyrum pernix K1 APE0042 | 47.0 | 56.0 | 74 | hypothetical protein |
| 1535 | 5035 | 1456066 | 1455350 | 717 | sp: GLPQ_BACSU | Bacillus subtilis glpQ | 26.2 | 50.0 | 244 | glycerophosphoryl diester phosphodiesterase |
| 1536 | 5036 | 1456355 | 1456948 | 594 | sp: TRMH_ECOLI | Escherichia coli K12 MG1655 trmH | 34.0 | 71.2 | 153 | tRNA(guanosine-2-0-)-methlytransferase |
| 1537 | 5037 | 1457047 | 1458066 | 1020 | sp: SYFA_BACSU | Bacillus subtilis 168 syfA | | | | phenylalanyl-tRNA synthetase alpha chain |
| 1538 | 5038 | 1458133 | 1460616 | 2484 | sp: SYFB_ECOLI | Escherichia coli K12 MG1655 syfB | 42.6 | 71.7 | 343 | phenylalanyl-tRNA synthetase beta chain |
| 1539 | 5039 | 1458966 | 1458196 | 771 | | | | | | |
| 1540 | 5040 | 1461157 | 1462128 | 972 | sp: ESTA_STRSC | Streptomyces scabies estA | 26.5 | 55.1 | 363 | esterase |
| 1541 | 5041 | 1462134 | 1463516 | 1383 | sp: MDMB_STRMY | Streptomyces mycarofaciens mdmB | 30.0 | 56.3 | 423 | macrolide 3-O-acyltransferase |
| 1542 | 5042 | 1463533 | 1463934 | 402 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1543 | 5043 | 1464083 | 1465123 | 1041 | gp: AF005242_1 | Corynebacterium glutamicum ASO19 argC | 98.3 | 99.1 | 347 | N-acetylglutamate-5-semialdehyde dehydrogenase |
| 1544 | 5044 | 1465210 | 1466373 | 1164 | sp: ARGJ_CORGL | Corynebacterium glutamicum ATCC 13032 argJ | 99.5 | 99.7 | 388 | glutamate N-acetyltransferase |
| 1545 | 5045 | 1467376 | 1468548 | 1173 | sp: ARGD_CORGL | Corynebacterium glutamicum ATCC 13032 argD | 99.0 | 99.2 | 391 | acetylornithine aminotransferase |
| 1546 | 5046 | 1470211 | 1471413 | 1203 | sp: ASSY_CORGL | Corynebacterium glutamicum ASO19 argG | 99.5 | 99.5 | 401 | argininosuccinate synthetase |
| 1547 | 5047 | 1471362 | 1470154 | 1209 | gp: AF048764_1 | Corynebacterium glutamicum ASO19 argH | 83.3 | 90.0 | 478 | argininosuccinate lyase |
| 1548 | 5048 | 1471477 | 1472907 | 1431 | | | | | | |
| 1549 | 5049 | 1472977 | 1474119 | 1143 | | | | | | |
| 1550 | 5050 | 1474119 | 1475693 | 1575 | | | | | | |
| 1551 | 5051 | 1475683 | 1476294 | 612 | | | | | | |
| 1552 | 5052 | 1476343 | 1476519 | 177 | sp: YCAR_ECOLI | Escherichia coli K12 ycaR | 48.0 | 72.0 | 50 | hypothetical protein |
| 1553 | 5053 | 1476550 | 1477809 | 1260 | sp: SYY1_BACSU | Bacillus subtilis syyl | 48.4 | 79.6 | 417 | tyrosyl-tRNA synthase (tyrosine—tRNA ligase) |
| 1554 | 5054 | 1478393 | 1477929 | 465 | sp: Y531_METJA | Methanococcus jannaschii MJ0531 | 26.9 | 64.4 | 149 | hypothetical protein |
| 1555 | 5055 | 1478892 | 1478503 | 390 | | | | | | |
| 1556 | 5056 | 1483475 | 1483335 | 141 | PIR: F81737 | Chlamydia muridarum Nigg TC0129 | 71.0 | 75.0 | 42 | hypothetical protein |
| 1557 | 5057 | 1483996 | 1483724 | 273 | GSP: Y35814 | Chlamydia pneumoniae | 61.0 | 66.0 | 84 | hypothetical protein |
| 1558 | 5058 | 1484675 | 1486027 | 1353 | sp: IF2_BORBU | Borrelia burgdorferi IF2 | 36.3 | 67.0 | 182 | translation initiation factor IF-2 |
| 1559 | 5059 | 1486042 | 1487025 | 984 | sp: YZGD_BACSU | Bacillus subtilis yzgD | 29.6 | 60.1 | 311 | hypothetical protein |
| 1560 | 5060 | 1487032 | 1487193 | 162 | | | | | | |
| 1561 | 5061 | 1487238 | 1488056 | 819 | sp: YQXC_BACSU | Bacillus subtilis yqxC | 38.5 | 69.6 | 260 | hypothetical protein |
| 1562 | 5062 | 1488146 | 1489018 | 873 | sp: YFJB_HAEIN | Mycobacterium tuberculosis H37Rv 1695 | 31.6 | 31.6 | 225 | hypothetical protein |
| 1563 | 5063 | 1489103 | 1490881 | 1779 | sp: RECN_ECOLI | Escherichia coli K12 recN | 31.4 | 63.4 | 574 | DNA repair protein |
| 1564 | 5064 | 1490944 | 1492134 | 1191 | pir: H70502 | Mycobacterium tuberculosis H37Rv 1697 | 41.9 | 73.1 | 394 | hypothetical protein |
| 1565 | 5065 | 1492147 | 1493109 | 963 | pir: A70503 | Mycobacterium tuberculosis H37Rv 1698 | 30.4 | 68.1 | 313 | hypothetical protein |
| 1566 | 5066 | 1493513 | 1495174 | 1662 | sp: PYRG_ECOLI | Escherichia coli K12 pyrG | 55.0 | 76.7 | 549 | CTP synthase (UTP—ammonia ligase) |
| 1567 | 5067 | 1495205 | 1495861 | 657 | sp: YQKG_BACSU | Bacillus subtilis yqkG | 36.3 | 71.3 | 157 | hypothetical protein |
| 1568 | 5068 | 1495861 | 1496772 | 912 | gp: AF093548_1 | Staphylococcus aureus xerD | 39.7 | 71.7 | 300 | tyrosine recombinase |
| 1569 | 5069 | 1498324 | 1496795 | 1530 | sp: TLRC_STRFR | Streptomyces fradiae tlrC | 30.5 | 59.7 | 551 | tyrosin resistance ATP-binding protein |
| 1570 | 5070 | 1498863 | 1499645 | 783 | gp: CCU87804_4 | Caulobacter crescentus parA | 44.6 | 73.6 | 258 | chromosome partitioning protein or ATPase involved in active partitioning of diverse bacterial plasmids |
| 1571 | 5071 | 1499931 | 1500695 | 765 | sp: YPUG_BACSU | Bacillus subtilis ypuG | 28.3 | 64.5 | 251 | hypothetical protein |
| 1572 | 5072 | 1501471 | 1500911 | 561 | | | | | | |
| 1573 | 5073 | 1501710 | 1502576 | 867 | gp: AF109156_1 | Datisca glomerata tst | 35.6 | 67.0 | 270 | thiosulfate sulfurtransferase |
| 1574 | 5074 | 1502634 | 1503176 | 543 | sp: YPUH_BACSU | Bacillus subtilis ypuH | 33.1 | 65.7 | 172 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1575 | 5075 | 1503483 | 1504238 | 756 | sp: RLUB_BACSU | Bacillus subtilis rluB | 45.9 | 72.5 | 229 | ribosomal large subunit pseudouridine synthase B |
| 1576 | 5076 | 1504256 | 1504945 | 690 | sp: KCY_BACSU | Bacillus subtilis cmk | 38.6 | 73.6 | 220 | cytidylate kinase |
| 1577 | 5077 | 1505017 | 1506573 | 1557 | sp: YPHC_BACSU | Bacillus subtilis yphC | 42.8 | 74.0 | 435 | GTP binding protein |
| 1578 | 5078 | 1507327 | 1506662 | 666 | | | | | | |
| 1579 | 5079 | 1507902 | 1507405 | 498 | | | | | | |
| 1580 | 5080 | 1508729 | 1507917 | 813 | sp: YX42_MYCTU | Mycobacterium tuberculosis Rv3342 | 36.2 | 67.2 | 232 | methyltransferase |
| 1581 | 5081 | 1508813 | 1510366 | 1554 | prf: 2513302B | Corynebacterium striatum M82B tetA | 29.7 | 60.1 | 499 | ABC transporter |
| 1582 | 5082 | 1510366 | 1512132 | 1767 | prf: 2513302A | Corynebacterium striatum M82B tetB | 31.2 | 56.3 | 602 | ABC transporter |
| 1583 | 5083 | 1511667 | 1510843 | 825 | | | | | | |
| 1584 | 5084 | 1512189 | 1512977 | 789 | sp: YGIE_ECOLI | Escherichia coli K12 ygiE | 39.7 | 73.2 | 257 | hypothetical membrane protein |
| 1585 | 5085 | 1514505 | 1514693 | 189 | | | | | | |
| 1586 | 5086 | 1514527 | 1512980 | 1548 | gp: AB029555_1 | Bacillus subtilis ATCC 9372 nhaG | 25.7 | 61.5 | 499 | Na+/H+ antiporter |
| 1587 | 5087 | 1515159 | 1514974 | 186 | | | | | | |
| 1588 | 5088 | 1515396 | 1515815 | 420 | | | | | | |
| 1589 | 5089 | 1515782 | 1515408 | 375 | sp: YCHJ_ECOLI | Escherichia coli K12 o249#9 ychJ | 36.9 | 57.7 | 130 | hypothetical protein |
| 1590 | 5090 | 1516962 | 1515799 | 1164 | pir: C69334 | Archaeoglobus fulgidus AF0675 | 25.2 | 63.8 | 210 | 2-hydroxy-6-oxohepta-2,4-dienoate hydrolase |
| 1591 | 5091 | 1517170 | 1519458 | 2289 | sp: SECA_BACSU | Bacillus subtilis secA | 35.2 | 61.7 | 805 | preprotein translocase SecA subunit |
| 1592 | 5092 | 1519601 | 1520029 | 429 | gp: AF173844_2 | Mycobacterium smegmatis garA | 75.8 | 93.2 | 132 | signal transduction protein |
| 1593 | 5093 | 1520190 | 1520945 | 756 | sp: Y0DF_MYCTU | Mycobacterium tuberculosis H37Rv Rv1828 | 41.9 | 74.4 | 234 | hypothetical protein |
| 1594 | 5094 | 1520957 | 1521589 | 633 | sp: Y0DE_MYCTU | Mycobacterium tuberculosis H37Rv Rv1828 | 30.8 | 63.2 | 133 | hypothetical protein |
| 1595 | 5095 | 1521771 | 1522343 | 573 | sp: Y0DE_MYCTU | Mycobacterium tuberculosis H37Rv Rv1828 | 71.4 | 84.3 | 178 | hypothetical protein |
| 1596 | 5096 | 1522941 | 1522432 | 510 | | | | | | |
| 1597 | 5097 | 1524500 | 1523052 | 1449 | | | | | | |
| 1598 | 5098 | 1525374 | 1525973 | 600 | | | | | | |
| 1599 | 5099 | 1525497 | 1524568 | 930 | | | | | | |
| 1600 | 5100 | 1526234 | 1525473 | 1062 | sp: YHDP_BACSU | Bacillus subtilis yhdP | 33.9 | 69.0 | 342 | hemolysin |
| 1601 | 5101 | 1527913 | 1526534 | 1380 | sp: YHDT_BACSU | Bacillus subtilis yhdT | 31.4 | 65.5 | 65 | hemolysin |
| 1602 | 5102 | 1527968 | 1528186 | 219 | | | | | | |
| 1603 | 5103 | 1529330 | 1527987 | 1344 | gp: TTHERAGEN_1 | Thermus thermophilus herA | 41.2 | 69.5 | 374 | DEAD box RNA helicase |
| 1604 | 5104 | 1529486 | 1530220 | 735 | sp: YD48_MYCTU | Mycobacterium tuberculosis H37Rv Rv1348 | 34.3 | 66.1 | 245 | ABC transporter ATP-binding protein |
| 1605 | 5105 | 1531816 | 1530341 | 1476 | gsp: W27613 | Brevibacterium flavum | 99.0 | 99.2 | 492 | 6-phosphogluconate dehydrogenase |
| 1606 | 5106 | 1531933 | 1532394 | 462 | pir: G70664 | Mycobacterium tuberculosis H37Rv Rv1847 | 39.7 | 67.8 | 121 | thioesterase |
| 1607 | 5107 | 1532322 | 1532996 | 675 | | | | | | |
| 1608 | 5108 | 1533041 | 1533781 | 741 | sp: NODL_RHIS3 | Rhizobium sp. N33 nodl | 39.6 | 68.1 | 235 | nodulation ATP-binding protein I |
| 1609 | 5109 | 1533781 | 1534521 | 741 | pir: E70501 | Mycobacterium tuberculosis H37Rv Rv1686c | 43.1 | 76.3 | 232 | hypothetical membrane protein |
| 1610 | 5110 | 1535401 | 1534529 | 873 | sp: YFHH_ECOLI | Escherichia coli K12 yfhH | 26.7 | 63.9 | 277 | transcriptional regulator |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1611 | 5111 | 1536227 | 1535382 | 846 | sp: PHNE_ECOLI | Escherichia coli K12 phnE | 29.9 | 63.4 | 281 | phosphonates transport system permease protein |
| 1612 | 5112 | 1537030 | 1536227 | 804 | sp: PHNE_ECOLI | Escherichia coli K12 phnE | 27.2 | 62.3 | 268 | phosphonates transport system permease protein |
| 1613 | 5113 | 1537833 | 1537030 | 804 | sp: PHNC_ECOLI | Escherichia coli K12 phnC | 44.8 | 72.0 | 250 | phosphonates transport ATP-binding protein |
| 1614 | 5114 | 1538759 | 1538968 | 210 | | | | | | |
| 1615 | 5115 | 1538919 | 1537870 | 1050 | | | | | | |
| 1616 | 5116 | 1539664 | 1538963 | 702 | | | | | | |
| 1617 | 5117 | 1541403 | 1539820 | 1584 | sp: THID_SALTY | Salmonella typhimurium thiD | 47.3 | 70.2 | 262 | phosphomethylpyrimidine kinase |
| 1618 | 5118 | 1542922 | 1542119 | 804 | sp: THIM_SALTY | Salmonella typhimurium LT2 thiM | 46.6 | 77.5 | 249 | hydoxyethylthiazole kinase |
| 1619 | 5119 | 1544976 | 1546289 | 1314 | pir: H70830 | Mycobacterium tuberculosis H37Rv ufaA1 | 28.6 | 55.0 | 451 | cyclopropane-fatty-acyl-phospholipid synthase |
| 1620 | 5120 | 1547692 | 1546307 | 1386 | prf: 2223339B | Burkholderia cepacia Pc701 mopB | 32.5 | 66.9 | 468 | sugar transporter or 4-methyl-o-phthalate/phthalate permease |
| 1621 | 5121 | 1548440 | 1547967 | 474 | prf: 2120352B | Thermus flavus AT-62 gpt | 36.5 | 59.0 | 156 | purine phosphoribosyltransferase |
| 1622 | 5122 | 1548651 | 1549349 | 699 | sp: YEBN_ECOLI | Escherichia coli K12 yebN | 39.8 | 68.5 | 206 | hypothetical protein |
| 1623 | 5123 | 1549403 | 1550398 | 996 | sp: AF178758_2 | Sinorhizobium sp. As4 arsB | 23.3 | 54.6 | 361 | arsenic oxyanion-translocation pump membrane subunit |
| 1624 | 5124 | 1550469 | 1550951 | 483 | | | | | | |
| 1625 | 5125 | 1551545 | 1552237 | 693 | sp: SCI7_33 | Streptomyces coelicolor A3(2) SCI7.33 | 62.2 | 83.8 | 222 | hypothetical protein |
| 1626 | 5126 | 1552518 | 1553972 | 1455 | gp: PSTRTETC1_6 | Pseudomonas sp. R9 ORFA | 51.8 | 83.6 | 469 | sulfate permease |
| 1627 | 5127 | 1553722 | 1553297 | 426 | GP: PSTRTETC1_7 | Pseudomonas sp. R9 ORFG | 39.0 | 50.0 | 97 | hypothetical protein |
| 1628 | 5128 | 1554684 | 1554070 | 615 | | | | | | |
| 1629 | 5129 | 1554861 | 1555067 | 207 | | | | | | |
| 1630 | 5130 | 1555079 | 1554891 | 189 | | | | | | |
| 1631 | 5131 | 1555835 | 1555086 | 750 | | | | | | |
| 1632 | 5132 | 1556376 | 1556771 | 396 | pir: A70945 | Mycobacterium tuberculosis H37Rv Rv2050 | 71.8 | 87.3 | 110 | hypothetical protein |
| 1633 | 5133 | 1557823 | 1557014 | 810 | prf: 2317468A | Schizosaccharomyces pombe dpm1 | 39.2 | 71.0 | 217 | dolichol phosphate mannose synthase |
| 1634 | 5134 | 1559493 | 1557859 | 1635 | sp: LNT_ECOLI | Escherichia coli K12 lnt | 25.1 | 55.6 | 527 | apolipoprotein N-acyltransferase |
| 1635 | 5135 | 1560237 | 1559497 | 741 | | | | | | |
| 1636 | 5136 | 1561660 | 1560437 | 1224 | gp: AF188894_1 | Candida albicans lip1 | 23.7 | 55.6 | 392 | secretory lipase |
| 1637 | 5137 | 1561780 | 1562553 | 774 | pir: C70764 | Mycobacterium tuberculosis H37Rv cobG | 31.3 | 56.7 | 291 | precorrin 2 methyltransferase |
| 1638 | 5138 | 1563802 | 1562525 | 1278 | sp: COBL_PSEDE | Pseudomonas denitrificans SC510 cobL | 32.4 | 60.8 | 411 | precorrin-6Y C5, 15-methyltransferase |
| 1639 | 5139 | 1563872 | 1564237 | 366 | | | | | | |
| 1640 | 5140 | 1564237 | 1564482 | 246 | | | | | | |
| 1641 | 5141 | 1565302 | 1564565 | 738 | sp: YY12_MYCTU | Mycobacterium tuberculosis H37Rv RV3412 | 54.1 | 75.4 | 244 | oxidoreductase |
| 1642 | 5142 | 1566438 | 1565302 | 1137 | gp: AF014460_1 | Streptococcus mutans LT11 pepQ | 36.1 | 61.3 | 382 | dipeptidase or X-Pro dipeptidase |
| 1643 | 5143 | 1566468 | 1567106 | 639 | | | | | | |
| 1644 | 5144 | 1569903 | 1567117 | 2787 | sp: MTR4_YEAST | Saccharomyces cerevisiae YIL050W dob1 | 26.5 | 55.7 | 1030 | ATP-dependent RNA helicase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1645 | 5145 | 1570933 | 1569932 | 1002 | sp: TATC_ECOLI | *Escherichia coli* K12 tatC | 28.7 | 62.7 | 268 | sec-independent protein translocase protein |
| 1646 | 5146 | 1571382 | 1571068 | 315 | sp: YY34_MYCLE | *Mycobacterium leprae* MLCB2533.27 | 44.7 | 69.4 | 85 | hypothetical protein |
| 1647 | 5147 | 1572486 | 1571506 | 981 | sp: YY35_MYCTU | *Mycobacterium tuberculosis* H37Rv Rv2095c | 31.9 | 61.2 | 317 | hypothetical protein |
| 1648 | 5148 | 1573463 | 1572492 | 972 | sp: YY36_MYCLE | *Mycobacterium leprae* MLCB2533.25 | 32.4 | 64.8 | 324 | hypothetical protein |
| 1649 | 5149 | 1574915 | 1573491 | 1425 | sp: YY37_MYCTU | *Mycobacterium tuberculosis* H37Rv Rv2097c | 53.1 | 77.3 | 467 | hypothetical protein |
| 1650 | 5150 | 1574957 | 1575205 | 249 | pir: B70512 | *Mycobacterium tuberculosis* H37Rv Rv2111c | 54.1 | 80.3 | 61 | hypothetical protein |
| 1651 | 5151 | 1575136 | 1574945 | 192 | | | | | | |
| 1652 | 5152 | 1576947 | 1575406 | 1542 | pir: C70512 | *Mycobacterium tuberculosis* H37Rv Rv2112c | 48.6 | 74.2 | 516 | hypothetical protein |
| 1653 | 5153 | 1577327 | 1577806 | 480 | PIR: H72504 | *Aeropyrum pernix* K1 APE2014 | 42.0 | 50.0 | 159 | hypothetical protein |
| 1654 | 5154 | 1578531 | 1576951 | 1581 | prf: 2422382Q | *Rhodococcus erythropolis* arc | 51.6 | 78.5 | 545 | AAA family ATPase (chaperone-like function) |
| 1655 | 5155 | 1579400 | 1578567 | 834 | pir: S72844 | *Mycobacterium leprae* pimT | 57.3 | 79.0 | 281 | protein-beta-aspartate methyltransferase |
| 1656 | 5156 | 1580771 | 1579449 | 1323 | gp: AF005050_1 | *Homo sapiens* | 38.1 | 67.2 | 436 | aspartyl aminopeptidase |
| 1657 | 5157 | 1580807 | 1581640 | 834 | pir: B70513 | *Mycobacterium tuberculosis* H37Rv Rv2119 | 45.4 | 71.4 | 269 | hypothetical protein |
| 1658 | 5158 | 1581851 | 1582114 | 264 | sp: VAPL_BACNO | *Dichelobacter nodosus* A198 vapI | 40.6 | 72.5 | 69 | virulence-associated protein |
| 1659 | 5159 | 1583481 | 1582273 | 1209 | prf: 2513299A | *Staphylococcus aureus* norA23 | 21.8 | 61.0 | 385 | quinolon resistance protein |
| 1660 | 5160 | 1585490 | 1583913 | 1578 | sp: ASPA_CORGL | *Corynebacterium glutamicum* (*Brevibacterium flavum*) MJ233 aspA | 99.8 | 99.8 | 526 | aspartate ammonia-lyase |
| 1661 | 5161 | 1586445 | 1585603 | 843 | gp: AF050166_1 | *Corynebacterium glutamicum* ASO19 hisG | 96.8 | 97.5 | 281 | ATP phosphoribosyltransferase |
| 1662 | 5162 | 1587504 | 1586812 | 693 | pir: H72277 | *Thermotoga maritima* MSB8 TM1254 | 30.8 | 63.1 | 195 | beta-phosphoglucomutase |
| 1663 | 5163 | 1591235 | 1587573 | 3663 | sp: METH_ECOLI | *Escherichia coli* K12 metH | 31.6 | 62.4 | 1254 | 5-methyltetrahydrofolate—homocysteine methyltransferase |
| 1664 | 5164 | 1591343 | 1591912 | 570 | | | | | | |
| 1665 | 5165 | 1592966 | 1591941 | 1026 | sp: AHPF_XANCH | *Xanthomonas campestris* ahpF | 22.4 | 49.5 | 366 | alkyl hydroperoxide reductase subunit F |
| 1666 | 5166 | 1593337 | 1594512 | 1176 | sp: ACR3_YEAST | *Saccharomyces cerevisiae* S288C YPR201W acr3 | 33.0 | 63.9 | 388 | arsenical-resistance protein |
| 1667 | 5167 | 1594532 | 1594951 | 420 | sp: ARSC_STAAU | *Staphylococcus aureus* plasmid pI258 arsC | 32.6 | 64.3 | 129 | arsenate reductase |
| 1668 | 5168 | 1595030 | 1595668 | 639 | pir: G70964 | *Mycobacterium tuberculosis* H37Rv arsC | 47.2 | 75.6 | 123 | arsenate reductase |
| 1669 | 5169 | 1596221 | 1595844 | 378 | | | | | | |
| 1670 | 5170 | 1597460 | 1596249 | 1212 | sp: SYC_ECOLI | *Escherichia coli* K12 cysS | 35.9 | 64.3 | 387 | cysteinyl-tRNA synthetase |
| 1671 | 5171 | 1598623 | 1597745 | 879 | sp: BACA_ECOLI | *Escherichia coli* K12 bacA | 37.3 | 69.4 | 255 | bacitracin resistance protein |
| 1672 | 5172 | 1598667 | 1599614 | 948 | prf: 2214302F | *Agrobacterium tumefaciens* mocA | 33.4 | 62.6 | 326 | oxidoreductase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1673 | 5173 | 1599679 | 1600677 | 999 | pir: F70577 | *Mycobacterium tuberculosis* H37Rv lppL | 27.0 | 53.5 | 359 | lipoprotein |
| 1674 | 5174 | 1600692 | 1601804 | 1113 | sp: PYRD_AGRAE | *Agrocybe aegerita* ura1 | 44.0 | 67.1 | 334 | dihydroorotate dehydrogenase |
| 1675 | 5175 | 1602281 | 1601931 | 351 | | | | | | |
| 1676 | 5176 | 1602660 | 1603466 | 807 | | | | | | |
| 1677 | 5177 | 1603520 | 1604629 | 1110 | gp: PSESTBCBAD_1 | *Pseudomonas syringae* tnpA | 34.7 | 55.3 | 360 | transposase |
| 1678 | 5178 | 1605315 | 1604830 | 486 | sp: YBHB_ECOLI | *Escherichia coli* K12 ybhB | 44.1 | 75.0 | 152 | bio operon ORF I (biotin biosynthetic enzyme) |
| 1679 | 5179 | 1605811 | 1605281 | 531 | | | | | | |
| 1680 | 5180 | 1605961 | 1606689 | 729 | GSP: Y74829 | *Neisseria meningitidis* | 26.0 | 33.0 | 198 | Neisserial polypeptides predicted to be useful antigens for vaccines and diagnostics |
| 1681 | 5181 | 1607646 | 1608248 | 603 | prf: 2513302A | *Corynebacterium striatum* M82B tetB | 43.6 | 68.7 | 597 | ABC transporter |
| 1682 | 5182 | 1607657 | 1605861 | 1797 | | | | | | |
| 1683 | 5183 | 1609087 | 1609335 | 249 | prf: 2513302B | *Corynebacterium striatum* M82B tetA | 36.8 | 67.1 | 535 | ABC transporter |
| 1684 | 5184 | 1609247 | 1607661 | 1587 | | | | | | |
| 1685 | 5185 | 1610192 | 1609842 | 351 | pir: JU0052 | *Streptomyces anulatus* pac | 32.4 | 56.4 | 56 | puromycin N-acetyltransferase |
| 1686 | 5186 | 1610236 | 1610844 | 609 | sp: ARGK_ECOLI | *Escherichia coli* K12 argK | 43.1 | 72.3 | 339 | LAO(lysine, arginine, and ornithine)/AO (arginine and ornithine)transport system kinase |
| 1687 | 5187 | 1612238 | 1611150 | 1089 | | | | | | |
| 1688 | 5188 | 1614444 | 1612234 | 2211 | sp: MUTB_STRCM | *Streptomyces cinnamonensis* A3823.5 mutB | 72.2 | 87.5 | 741 | methylmalonyl-CoA mutase alpha subunit |
| 1689 | 5189 | 1616298 | 1614451 | 1848 | sp: MUTA_STRCM | *Streptomyces cinnamonensis* A3823.5 mutA | 41.6 | 68.2 | 610 | methylmalonyl-CoA mutase beta subunit |
| 1690 | 5190 | 1616578 | 1617300 | 723 | sp: YS13_MYCTU | *Mycobacterium tuberculosis* H37Rv Rv1491c | 39.7 | 70.1 | 224 | hypothetical membrane protein |
| 1691 | 5191 | 1617398 | 1617994 | 597 | sp: YS09_MYCTU | *Mycobacterium tuberculosis* H37Rv Rv1488 | 64.1 | 87.0 | 370 | hypothetical membrane protein |
| 1692 | 5192 | 1619616 | 1618321 | 1296 | | | | | | |
| 1693 | 5193 | 1620106 | 1619672 | 435 | pir: B70711 | *Mycobacterium tuberculosis* H37Rv Rv1487 | 44.7 | 78.7 | 141 | hypothetical membrane protein |
| 1694 | 5194 | 1621009 | 1620167 | 843 | gp: SCC77_24 | *Streptomyces coelicolor* A3(2) SCC77.24 | 51.0 | 72.8 | 261 | hypothetical protein |
| 1695 | 5195 | 1621056 | 1621838 | 783 | sp: HEMZ_PROFR | *Propionibacterium freudenreichii* subsp. *Shermanii* hemH | 36.8 | 65.7 | 364 | ferrochelatase |
| 1696 | 5196 | 1622950 | 1621841 | 1110 | sp: P54_ENTFC | *Streptococcus faecium* | 25.5 | 56.5 | 611 | invasin |
| 1697 | 5197 | 1624826 | 1623027 | 1800 | pir: F70873 | *Mycobacterium tuberculosis* H37Rv acn | 69.9 | 85.9 | 959 | aconitate hydratase |
| 1698 | 5198 | 1625925 | 1625428 | 498 | | | | | | |
| 1699 | 5199 | 1626279 | 1629107 | 2829 | | | | | | |
| 1700 | 5200 | 1629298 | 1629861 | 564 | pir: E70873 | *Mycobacterium tuberculosis* H37Rv Rv1474c | 54.6 | 81.6 | 174 | transcriptional regulator |
| 1701 | 5201 | 1629913 | 1630668 | 756 | pir: F64496 | *Methanococcus jannaschii* MJ1575 guaA | 21.3 | 51.9 | 235 | GMP synthetase |
| 1702 | 5202 | 1631329 | 1630667 | 663 | gp: SCD82_4 | *Streptomyces coelicolor* A3(2) SCD82.04c | 32.6 | 62.0 | 221 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1703 | 5203 | 1631660 | 1631926 | 267 | pir: E64494 | *Methanococcus jannaschii* MJ1558 | 37.2 | 80.2 | 86 | hypothetical protein |
| 1704 | 5204 | 1631745 | 1631353 | 393 | | *Neisseria meningitidis* MC58 NMB1652 | 61.2 | 86.1 | 446 | hypothetical protein |
| 1705 | 5205 | 1631933 | 1633324 | 1392 | gp: AE002515_9 | | | | | |
| 1706 | 5206 | 1632588 | 1632109 | 480 | GSP: Y38838 | *Neisseria gonorrhoeae* ORF24 | 54.0 | 60.0 | 113 | antigenic protein |
| 1707 | 5207 | 1633137 | 1632682 | 456 | GSP: Y38838 | *Neisseria gonorrhoeae* | 59.0 | 69.0 | 152 | antigenic protein |
| 1708 | 5208 | 1633566 | 1636241 | 2676 | sp: ATA1_SYNY3 | *Synechocystis* sp. PCC6803 sll1614 pma1 | 42.6 | 73.2 | 883 | cation-transporting ATPase P |
| 1709 | 5209 | 1634563 | 1633781 | 783 | | | | | | |
| 1710 | 5210 | 1636732 | 1636244 | 489 | gp: SC3D11_2 | *Streptomyces coelicolor* A3(2) SC3D11.02c | 35.8 | 58.3 | 120 | hypothetical protein |
| 1711 | 5211 | 1637081 | 1638442 | 1362 | | | | | | |
| 1712 | 5212 | 1639132 | 1638776 | 357 | | | | | | |
| 1713 | 5213 | 1639365 | 1639520 | 156 | | | | | | |
| 1714 | 5214 | 1639656 | 1639811 | 162 | | | | | | |
| 1715 | 5215 | 1639781 | 1640155 | 375 | prf: 2408488H | *Streptococcus thermophilus* phage TP-J34 | 43.0 | 73.8 | 107 | host cell surface-exposed lipoprotein |
| 1716 | 5216 | 1640546 | 1641001 | 456 | prf: 2510491A | *Corynephage* 304L int | 34.4 | 60.4 | 154 | integrase |
| 1717 | 5217 | 1642674 | 1641046 | 1629 | sp: YJJK_ECOLI | *Escherichia coli* K12 yjjK | 32.8 | 64.4 | 497 | ABC transporter ATP-binding protein |
| 1718 | 5218 | 1644218 | 1642743 | 1476 | | | | | | |
| 1719 | 5219 | 1645499 | 1644318 | 1182 | sp: NANH_MICVI | *Micromonospora viridifaciens* ATCC 31146 nedA | 51.9 | 72.4 | 387 | sialidase |
| 1720 | 5220 | 1645661 | 1646368 | 708 | gp: AF121000_8 | *Corynebacterium glutamicum* 22243 R-plasmid pAG1 tnpB | 99.6 | 100.0 | 236 | transposase (IS1628) |
| 1721 | 5221 | 1645821 | 1646063 | 243 | GPU: AF164956_23 | *Corynebacterium glutamicum* TnpNC | 64.0 | 72.0 | 37 | transposase protein fragment |
| 1722 | 5222 | 1645861 | 1645601 | 261 | GP: NT1TNIS_5 | Plasmid NTP16 | 32.0 | 43.0 | 88 | hypothetical protein |
| 1723 | 5223 | 1646549 | 1647133 | 585 | | | | | | |
| 1724 | 5224 | 1647634 | 1647212 | 423 | pir: B75015 | *Pyrococcus abyssi* Orsay PAB1087 | 32.7 | 70.1 | 107 | dTDP-4-keto-L-rhamnose reductase |
| 1725 | 5225 | 1648097 | 1647651 | 447 | pir: B75074 | *Mycobacterium leprae* MLCL536.24c nifU7 | 63.8 | 85.2 | 149 | nitrogen fixation protein |
| 1726 | 5226 | 1648548 | 1648709 | 162 | PIR: C72506 | *Aeropyrum pernix* K1 APE2025 | 48.0 | 57.0 | 52 | hypothetical protein |
| 1727 | 5227 | 1649362 | 1648100 | 1263 | pir: S72761 | *Mycobacterium leprae* nifS | 64.7 | 84.4 | 411 | nitrogen fixation protein |
| 1728 | 5228 | 1650122 | 1649367 | 756 | gp: SCC22_4 | *Streptomyces coelicolor* A3(2) SCC22.04c | 70.2 | 89.3 | 252 | ABC transporter ATP-binding protein |
| 1729 | 5229 | 1651424 | 1650249 | 1176 | pir: A70872 | *Mycobacterium tuberculosis* H37Rv Rv1462 | 55.2 | 83.0 | 377 | hypothetical protein |
| 1730 | 5230 | 1652875 | 1651433 | 1443 | sp: Y074_SYNY3 | *Synechocystis* sp. PCC6803 slr0074 | 41.0 | 73.0 | 493 | ABC transporter |
| 1731 | 5231 | 1653586 | 1652894 | 693 | gp: SCC22_8 | *Streptomyces coelicolor* A3(2) SCC22.08c | 46.1 | 71.4 | 217 | DNA-binding protein |
| 1732 | 5232 | 1654043 | 1655671 | 1629 | pir: F70871 | *Mycobacterium tuberculosis* H37Rv Rv1459c | 36.3 | 67.8 | 518 | hypothetical membrane protein |
| 1733 | 5233 | 1655681 | 1656700 | 1020 | pir: S72783 | *Mycobacterium leprae* MLCL536.31 abc2 | 50.2 | 77.3 | 317 | ABC transporter |
| 1734 | 5234 | 1656712 | 1657515 | 804 | pir: S72778 | *Mycobacterium leprae* MLCL536.32 | 41.0 | 74.8 | 266 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1735 | 5235 | 1657677 | 1658675 | 999 | pir: C70871 | Mycobacterium tuberculosis H37Rv Rv1456c | 43.0 | 74.6 | 291 | hypothetical protein |
| 1736 | 5236 | 1659496 | 1659140 | 357 | | | | | | |
| 1737 | 5237 | 1659508 | 1661136 | 1629 | pir: C71156 | Pyrococcus horikoshii PH0450 | 23.4 | 51.0 | 418 | helicase |
| 1738 | 5238 | 1661578 | 1662552 | 975 | sp: QOR_ECOLI | Escherichia coli K12 qor | 37.5 | 70.9 | 323 | quinone oxidoreductase |
| 1739 | 5239 | 1663598 | 1662630 | 969 | gp: NWCOXABC_3 | Nitrobacter winogradskyi coxC | 37.6 | 66.8 | 295 | cytochrome o ubiquinol oxidase assembly factor/heme O synthase |
| 1740 | 5240 | 1664403 | 1666502 | 2100 | gp: AB023377_1 | Corynebacterium glutamicum ATCC 31833 tkt | 100.0 | 100.0 | 675 | transketolase |
| 1741 | 5241 | 1666673 | 1667752 | 1080 | sp: TAL_MYCLE | Mycobacterium leprae MLCL536.39 tal | 62.0 | 85.2 | 358 | transaldolase |
| 1742 | 5242 | 1667764 | 1666601 | 1164 | gsp: W27612 | Brevibacterium flavum | 99.8 | 100.0 | 484 | glucose-6-phosphate dehydrogenase |
| 1743 | 5243 | 1667950 | 1669401 | 1452 | | | | | | |
| 1744 | 5244 | 1669419 | 1670375 | 957 | pir: A70917 | Mycobacterium tuberculosis H37Rv Rv1446c opcA | 40.6 | 71.7 | 318 | oxppcycle protein (glucose 6-phosphate dehydrogenase assembly protein) |
| 1745 | 5245 | 1670395 | 1671099 | 705 | sp: SOL3_YEAST | Saccharomyces cerevisiae S288C YHR163W sol3 | 28.7 | 58.1 | 258 | 6-phosphogluconolactonase |
| 1746 | 5246 | 1671677 | 1671273 | 405 | sp: SAOX_BACSN | Bacillus sp. NS-129 | 35.2 | 57.8 | 128 | sarcosine oxidase |
| 1747 | 5247 | 1671723 | 1673123 | 1401 | gp: AF126281_1 | Rhodococcus erythropolis | 24.6 | 46.6 | 500 | transposase (IS1676) |
| 1748 | 5248 | 1674105 | 1673266 | 840 | gp: CGL007732_5 | Corynebacterium glutamicum ATCC 13032 soxA | 100.0 | 100.0 | 205 | sarcosine oxidase |
| 1749 | 5249 | 1677211 | 1677384 | 174 | | | | | | |
| 1750 | 5250 | 1678756 | 1678070 | 687 | | | | | | |
| 1751 | 5251 | 1679148 | 1680128 | 981 | | | | | | |
| 1752 | 5252 | 1681108 | 1680332 | 777 | sp: TPIS_CORGL | Corynebacterium glutamicum AS019 ATCC 13059 tpiA | 99.2 | 99.6 | 259 | triose-phosphate isomerase |
| 1753 | 5253 | 1681263 | 1681670 | 408 | SP: YCQ3_YEAST | Saccharomyces cerevisiae YCR013c | 37.0 | 51.0 | 128 | probable membrane protein |
| 1754 | 5254 | 1682404 | 1681190 | 1215 | sp: PGK_CORGL | Corynebacterium glutamicum AS019 ATCC 13059 pgk | 98.0 | 98.5 | 405 | phosphoglycerate kinase |
| 1755 | 5255 | 1683625 | 1682624 | 1002 | sp: G3P_CORGL | Corynebacterium glutamicum AS019 ATCC 13059 gap | 99.1 | 99.7 | 333 | glyceraldehyde-3-phosphate dehydrogenase |
| 1756 | 5256 | 1685097 | 1684117 | 981 | pir: D70903 | Mycobacterium tuberculosis H37Rv Rv1423 | 63.9 | 87.4 | 324 | hypothetical protein |
| 1757 | 5257 | 1686132 | 1685110 | 1023 | sp: YR40_MYCTU | Mycobacterium tuberculosis H37Rv Rv1422 | 56.3 | 82.5 | 309 | hypothetical protein |
| 1758 | 5258 | 1687078 | 1686152 | 927 | sp: YR39_MYCTU | Mycobacterium tuberculosis H37Rv Rv1421 | 52.0 | 76.2 | 281 | hypothetical protein |
| 1759 | 5259 | 1689190 | 1687103 | 2088 | sp: UVRC_PSEFL | Synechocystis sp. PCC6803 uvrC | 34.4 | 61.5 | 701 | excinuclease ABC subunit C |
| 1760 | 5260 | 1689779 | 1689201 | 579 | sp: YR35_MYCTU | Mycobacterium tuberculosis H37Rv Rv1417 | 32.7 | 68.7 | 150 | hypothetical protein |
| 1761 | 5261 | 1690345 | 1689869 | 477 | SP: RISB_ECOLI | Escherichia coli K12 | 43.5 | 72.1 | 154 | 6,7-dimethyl-8-ribityllumazine synthase |
| 1762 | 5262 | 1690694 | 1690921 | 228 | GSP: Y83273 | Bacillus subtilis | 59.0 | 68.0 | 72 | polypeptide encoded by rib operon |
| 1763 | 5263 | 1690708 | 1691421 | 714 | GSP: Y83272 | Bacillus subtilis | 26.0 | 48.0 | 217 | riboflavin biosynthetic protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1764 | 5264 | 1691012 | 1691347 | 336 | GSP: Y83273 | Bacillus subtilis | 44.0 | 52.0 | 106 | polypeptide encoded by rib operon |
| 1765 | 5265 | 1691625 | 1690360 | 1266 | gp: AF001929_1 | Mycobacterium tuberculosis ribA | 65.6 | 84.7 | 404 | GTP cyclohydrolase II and 3,4-dihydroxy-2-butanone 4-phosphate synthase (riboflavin synthesis) |
| 1766 | 5266 | 1692271 | 1691639 | 633 |  | Actinobacillus pleuropneumoniae ISU-178 ribE | 47.4 | 79.2 | 211 | riboflavin synthase alpha chain |
| 1767 | 5267 | 1693258 | 1692275 | 984 | sp: RIBD_ECOLI | Escherichia coli K12 ribD | 37.3 | 62.7 | 365 | riboflavin-specific deaminase |
| 1768 | 5268 | 1693918 | 1693262 | 657 | sp: RPE_YEAST | Saccharomyces cerevisiae S288C YJL121C rpe1 | 43.6 | 73.1 | 234 | ribulose-phosphate 3-epimerase |
| 1769 | 5269 | 1695298 | 1693967 | 1332 | sp: SUN_ECOLI | Escherichia coli K12 sun | 30.8 | 60.7 | 448 | nucleolar protein NOL1/NOP2 (eukaryotes) family |
| 1770 | 5270 | 1696443 | 1695499 | 945 | sp: FMT_PSEAE | Pseudomonas aeruginosa fmt | 41.6 | 67.9 | 308 | methionyl-tRNA formyltransferase |
| 1771 | 5271 | 1696972 | 1696466 | 507 | sp: DEF_BACSU | Bacillus subtilis 168 def | 44.7 | 72.7 | 150 | polypeptide deformylase |
| 1772 | 5272 | 1699147 | 1697084 | 2064 | sp: PRIA_ECOLI | Escherichia coli priA | 22.9 | 46.3 | 725 | primosomal protein n |
| 1773 | 5273 | 1700397 | 1699177 | 1221 | gsp: R80060 | Brevibacterium flavum MJ-233 | 99.3 | 99.5 | 407 | S-adenosylmethionine synthetase |
| 1774 | 5274 | 1701767 | 1700508 | 1260 | sp: DFP_MYCTU | Mycobacterium tuberculosis H37Rv RV1391 dfp | 58.0 | 80.9 | 409 | DNA/pantothenate metabolism flavoprotein |
| 1775 | 5275 | 1702322 | 1702032 | 291 |  | Mycobacterium tuberculosis H37Rv Rv1390 | 70.4 | 87.7 | 81 | hypothetical protein |
| 1776 | 5276 | 1703037 | 1702411 | 627 | pir: KIBYGU | Saccharomyces cerevisiae guk1 | 39.8 | 74.7 | 186 | guanylate kinase |
| 1777 | 5277 | 1703308 | 1702991 | 318 | pir: B70899 | Mycobacterium tuberculosis H37Rv Rv1388 mIHF | 80.6 | 90.3 | 103 | integration host factor |
| 1778 | 5278 | 1704350 | 1703517 | 834 | sp: DCOP_MYCTU | Mycobacterium tuberculosis H37Rv | 51.8 | 73.6 | 276 | orotidine-5'-phosphate decarboxylase |
| 1779 | 5279 | 1707697 | 1704359 | 3339 | pir: SYECCP | Escherichia coli carB | 53.1 | 77.5 | 1122 | carbamoyl-phosphate synthase large chain |
| 1780 | 5280 | 1708884 | 1707706 | 1179 | sp: CARA_PSEAE | Pseudomonas aeruginosa ATCC 15692 carA | 45.4 | 70.1 | 381 | carbamoyl-phosphate synthase small chain |
| 1781 | 5281 | 1710357 | 1709017 | 1341 | sp: PYRC_BACCL | Bacillus caldolyticus DSM 405 pyrC | 42.8 | 67.7 | 402 | dihydroorotase |
| 1782 | 5282 | 1711348 | 1710413 | 936 | sp: PYRB_PSEAE | Pseudomonas aeruginosa ATCC 15692 | 48.6 | 79.7 | 311 | aspartate carbamoyltransferase |
| 1783 | 5283 | 1711927 | 1711352 | 576 | sp: PYRR_BACCL | Bacillus caldolyticus DSM 405 pyrR | 54.0 | 80.1 | 176 | phosphoribosyl transferase or pyrimidine operon regulatory protein |
| 1784 | 5284 | 1712596 | 1713759 | 1164 | sp: Y00R_MYCTU | Mycobacterium tuberculosis H37Rv Rv2216 | 39.7 | 73.4 | 297 | cell division inhibitor |
| 1785 | 5285 | 1713830 | 1714306 | 477 |  |  |  |  |  |  |
| 1786 | 5286 | 1714299 | 1714760 | 462 |  |  |  |  |  |  |
| 1787 | 5287 | 1714741 | 1714950 | 210 |  |  |  |  |  |  |
| 1788 | 5288 | 1716062 | 1715382 | 681 | sp: NUSB_BACSU | Bacillus subtilis nusB | 33.6 | 69.3 | 137 | N utilization substance protein B (regulation of rRNA biosynthesis by transcriptional antitermination) |
| 1789 | 5289 | 1716692 | 1716132 | 561 | sp: EFP_BRELA | Brevibacterium lactofermentum ATCC 13869 efp | 97.9 | 98.4 | 187 | elongation factor P |
| 1790 | 5290 | 1717868 | 1716780 | 1089 | gp: AF124600_4 | Corynebacterium glutamicum AS019 pepQ | 99.5 | 100.0 | 217 | cytoplasmic peptidase |
| 1791 | 5291 | 1719032 | 1717938 | 1095 | gp: AF124600_3 | Corynebacterium glutamicum AS019 aroB | 98.6 | 99.7 | 361 | 3-dehydroquinate synthase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1792 | 5292 | 1719598 | 1719107 | 492 | gp: AF124600_2 | Corynebacterium glutamicum AS019 aroK | 100.0 | 100.0 | 166 | shikimate kinase |
| 1793 | 5293 | 1721381 | 1720971 | 411 | sp: LEP3_AERHY | Aeromonas hydrophila tapD | 35.2 | 54.9 | 142 | type IV prepilin-like protein specific leader peptidase |
| 1794 | 5294 | 1721725 | 1721423 | 303 | gp: SC1A2_22 | Streptomyces coelicolor A3(2) SC1A2.22 | 45.8 | 68.7 | 83 | bacterial regulatory protein, arsR family |
| 1795 | 5295 | 1721780 | 1722853 | 1074 | gp: AF109162_2 | Corynebacterium diphtheriae hmuU | 35.9 | 73.2 | 340 | ABC transporter |
| 1796 | 5296 | 1722807 | 1722202 | 606 | pir: A75169 | Pyrococcus abyssi Orsay PAB0349 | 23.6 | 50.7 | 373 | iron(III) ABC transporter, periplasmic-binding protein |
| 1797 | 5297 | 1722870 | 1723826 | 957 | | | | | | |
| 1798 | 5298 | 1723826 | 1724578 | 753 | sp: FHUC_BACSU | Bacillus subtilis 168 fhuC | 38.3 | 71.7 | 230 | ferrichrome transport ATP-binding protein |
| 1799 | 5299 | 1725439 | 1724612 | 828 | pir: D70660 | Mycobacterium tuberculosis H37Rv aroE | 50.0 | 60.0 | 259 | shikimate 5-dehydrogenase |
| 1800 | 5300 | 1726625 | 1725459 | 1167 | pir: E70660 | Mycobacterium tuberculosis H37Rv Rv2553c | 41.8 | 70.1 | 395 | hypothetical protein |
| 1801 | 5301 | 1727170 | 1726625 | 546 | pir: F70660 | Mycobacterium tuberculosis H37Rv Rv2554c | 52.8 | 69.6 | 161 | hypothetical protein |
| 1802 | 5302 | 1730048 | 1727385 | 2664 | sp: SYA_THIFE | Thiobacillus ferrooxidans ATCC 33020 alaS | 43.3 | 71.8 | 894 | alanyl-tRNA synthetase |
| 1803 | 5303 | 1731542 | 1730166 | 1377 | sp: Y0A9_MYCTU | Mycobacterium tuberculosis H37Rv Rv2559c | 65.4 | 84.8 | 454 | hypothetical protein |
| 1804 | 5304 | 1732822 | 1731599 | 1224 | sp: SYD_MYCLE | Mycobacterium leprae aspS | 71.1 | 89.2 | 591 | aspartyl-tRNA synthetase |
| 1805 | 5305 | 1734811 | 1732988 | 1824 | sp: Y0BQ_MYCTU | Mycobacterium tuberculosis H37Rv Rv2575 | 46.1 | 74.1 | 297 | hypothetical protein |
| 1806 | 5306 | 1735056 | 1735946 | 891 | | | | | | |
| 1807 | 5307 | 1738679 | 1736004 | 2676 | sp: AMYH_YEAST | Saccharomyces cerevisiae S288C YIR019C sta1 | 26.1 | 53.6 | 839 | glucan 1,4-alpha-glucosidase |
| 1808 | 5308 | 1740569 | 1738713 | 1857 | sp: YHGE_BACSU | Bacillus subtilis yhgE | 23.1 | 54.0 | 742 | phage infection protein |
| 1809 | 5309 | 1741219 | 1740572 | 648 | | | | | | |
| 1810 | 5310 | 1741313 | 1741906 | 594 | gp: SCE68_13 | Streptomyces coelicolor A3(2) SCE68.13 | 29.2 | 62.0 | 192 | transcriptional regulator |
| 1811 | 5311 | 1741893 | 1742606 | 714 | gp: SCE15_13 | Streptomyces coelicolor A3(2) SCE15.13c | 72.8 | 88.1 | 371 | oxidoreductase |
| 1812 | 5312 | 1742701 | 1743813 | 1113 | | | | | | |
| 1813 | 5313 | 1743843 | 1743968 | 126 | sp: SLFA_PSEAE | Pseudomonas aeruginosa PAO1 slfA | 37.1 | 77.6 | 116 | NADH-dependent FMN reductase |
| 1814 | 5314 | 1744025 | 1744519 | 495 | | | | | | |
| 1815 | 5315 | 1744884 | 1746230 | 1347 | sp: SDHL_ECOLI | Escherichia coli K12 sdaA | 46.8 | 71.4 | 462 | L-serine dehydratase |
| 1816 | 5316 | 1746728 | 1747588 | 861 | | | | | | |
| 1817 | 5317 | 1747918 | 1746233 | 1686 | prf: 2423362A | Enterococcus casseliflavus glpO | 28.4 | 53.9 | 598 | alpha-glycerolphosphate oxidase |
| 1818 | 5318 | 1749276 | 1747990 | 1287 | sp: SYH_STAAU | Staphylococcus aureus SR17238 hisS | 43.2 | 72.2 | 421 | histidyl-tRNA synthetase |
| 1819 | 5319 | 1749963 | 1749325 | 639 | gp: CJ11168X3_127 | Campylobacter jejuni NCTC11168 Cj0809c | 40.3 | 62.1 | 211 | hydrolase |
| 1820 | 5320 | 1750427 | 1750933 | 507 | prf: 2313309A | Streptomyces chrysomallus sccypB | 35.4 | 61.1 | 175 | cyclophilin |
| 1821 | 5321 | 1750964 | 1751200 | 237 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1822 | 5322 | 1751497 | 1752051 | 555 | gp: AF038651_4 | *Corynebacterium glutamicum* ATCC 13032 orf4 | 98.4 | 100.0 | 128 | hypothetical protein |
| 1823 | 5323 | 1752186 | 1752527 | 342 | | | | | | |
| | 5324 | 1754894 | 1752615 | 2280 | gp: AF038651_3 | *Corynebacterium glutamicum* ATCC 13032 rel | 99.9 | 99.9 | 760 | GTP pyrophosphokinase |
| 1825 | 5325 | 1755479 | 1754925 | 555 | gp: AF038651_2 | *Corynebacterium glutamicum* ATCC 13032 apt | 99.5 | 100.0 | 185 | adenine phosphoribosyltransferase |
| 1826 | 5326 | 1755748 | 1755599 | 150 | gp: AF038651_1 | *Corynebacterium glutamicum* ATCC 13032 dciAE | 98.0 | 98.8 | 49 | dipeptide transport system |
| 1827 | 5327 | 1757228 | 1755486 | 1743 | sp: Y0BG_MYCTU | *Mycobacterium tuberculosis* H37Rv Rv2585c | 30.7 | 60.9 | 558 | hypothetical protein |
| 1828 | 5328 | 1758797 | 1757589 | 1209 | sp: SECF_ECOLI | *Escherichia coli* K12 secF | 25.9 | 57.2 | 332 | protein-export membrane protein |
| 1829 | 5329 | 1759707 | 1760336 | 630 | | | | | | |
| 1830 | 5330 | 1760734 | 1758803 | 1932 | prf: 2313285A | *Rhodobacter capsulatus* secD | 24.4 | 52.0 | 616 | protein-export membrane protein |
| 1831 | 5331 | 1761367 | 1761005 | 363 | sp: Y0BD_MYCLE | *Mycobacterium leprae* MLCB1259.04 | 39.6 | 66.0 | 106 | hypothetical protein |
| 1832 | 5332 | 1762498 | 1761419 | 1080 | sp: RUVB_ECOLI | *Escherichia coli* K12 nuvB | 55.3 | 81.9 | 331 | holliday junction DNA helicase |
| 1833 | 5333 | 1763134 | 1762517 | 618 | sp: RUVA_MYCLE | *Mycobacterium leprae* nuvA | 45.2 | 74.3 | 210 | holliday junction DNA helicase |
| 1834 | 5334 | 1763839 | 1763177 | 663 | sp: RUVC_ECOLI | *Escherichia coli* K12 nuvC | 35.6 | 63.3 | 180 | crossover junction endodeoxyribonuclease |
| 1835 | 5335 | 1764742 | 1763990 | 753 | sp: YEBC_ECOLI | *Escherichia coli* K12 ORF246 yebC | 49.2 | 78.4 | 250 | hypothetical protein |
| 1836 | 5336 | 1765860 | 1765015 | 846 | sp: TESB_ECOLI | *Escherichia coli* K12 tesB | 38.5 | 68.6 | 283 | acyl-CoA thiolesterase |
| 1837 | 5337 | 1765969 | 1766442 | 474 | gp: SC10A5_9 | *Streptomyces coelicolor* A3(2) SC10A5.09c | 31.5 | 61.3 | 111 | hypothetical protein |
| 1838 | 5338 | 1766948 | 1766487 | 462 | pir: H70570 | *Mycobacterium tuberculosis* H37Rv Rv2609c | 38.2 | 61.2 | 170 | hypothetical protein |
| 1839 | 5339 | 1768030 | 1766948 | 1083 | sp: GPT3_YEAST | *Saccharomyces cerevisiae* S288C spt14 | 21.7 | 49.3 | 414 | hexosyltransferase or N-acetylglucosaminyl-phosphatidylinositol biosynthetic protein |
| 1840 | 5340 | 1768996 | 1768034 | 963 | gp: SCL2_16 | *Streptomyces coelicolor* A3(2) SCL2.16c | 46.4 | 67.8 | 295 | acyltransferase |
| 1841 | 5341 | 1769678 | 1769022 | 657 | pir: C70571 | *Mycobacterium tuberculosis* H37Rv Rv2612c pgsA | 48.2 | 78.0 | 78 | CDP-diacylglycerol—glycerol-3-phosphate phosphatidyltransferase |
| 1842 | 5342 | 1770340 | 1769681 | 660 | pir: D70571 | *Mycobacterium tuberculosis* H37Rv Rv2613c | 54.6 | 78.4 | 194 | histidine triad (HIT) family protein |
| 1843 | 5343 | 1772384 | 1770327 | 2058 | sp: SYT2_BACSU | *Bacillus subtilis* thrZ | 42.0 | 68.9 | 647 | threonyl-tRNA synthetase |
| 1844 | 5344 | 1772863 | 1772658 | 1206 | sp: YWBN_BACSU | *Bacillus subtilis* ywbN | 34.3 | 61.8 | 400 | hypothetical protein |
| 1845 | 5345 | 1773881 | 1774444 | 564 | | | | | | |
| 1846 | 5346 | 1774438 | 1773893 | 546 | | | | | | |
| 1847 | 5347 | 1775191 | 1774457 | 735 | | | | | | |
| 1848 | 5348 | 1777269 | 1777646 | 378 | | | | | | |
| 1849 | 5349 | 1777444 | 1778037 | 594 | | | | | | |
| 1850 | 5350 | 1779508 | 1778102 | 1407 | | | | | | |
| 1851 | 5351 | 1780168 | 1779554 | 615 | | | | | | |
| 1852 | 5352 | 1780905 | 1780507 | 399 | | | | | | |
| 1853 | 5353 | 1781585 | 1781019 | 567 | sp: PUAC_STRLP | *Streptomyces anulatus* pac | 36.3 | 64.2 | 190 | puromycin N-acetyltransferase |
| 1854 | 5354 | 1781705 | 1782790 | 1086 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1855 | 5355 | 1783281 | 1784381 | 1101 | | | | | | |
| 1856 | 5356 | 1784080 | 1783382 | 699 | | | | | | |
| 1857 | 5357 | 1785473 | 1782894 | 2580 | | | | | | |
| 1858 | 5358 | 1786844 | 1785732 | 1113 | | | | | | |
| 1859 | 5359 | 1788829 | 1786907 | 1923 | | | | | | |
| 1860 | 5360 | 1789080 | 1789562 | 483 | | | | | | |
| 1861 | 5361 | 1789580 | 1789768 | 189 | | | | | | |
| 1862 | 5362 | 1789746 | 1790057 | 312 | | | | | | |
| 1863 | 5363 | 1790889 | 1790461 | 429 | | | | | | |
| 1864 | 5364 | 1791842 | 1792438 | 597 | sp: AFUC_ACTPL | Actinobacillus pleuropneumoniae afuC | 28.7 | 28.7 | 202 | ferric transport ATP-binding protein |
| 1865 | 5365 | 1792428 | 1793426 | 999 | | | | | | |
| 1866 | 5366 | 1793654 | 1793496 | 159 | | | | | | |
| 1867 | 5367 | 1793714 | 1794820 | 1107 | | | | | | |
| 1868 | 5368 | 1795202 | 1795621 | 420 | | | | | | |
| 1869 | 5369 | 1795591 | 1796181 | 591 | gp: AF088896_20 | Zymomonas mobilis dfp | 27.1 | 66.7 | 129 | pantothenate metabolism flavoprotein |
| 1870 | 5370 | 1796186 | 1797049 | 864 | | | | | | |
| 1871 | 5371 | 1797350 | 1797769 | 420 | | | | | | |
| 1872 | 5372 | 1797969 | 1797850 | 120 | | | | | | |
| 1873 | 5373 | 1798757 | 1798023 | 735 | | | | | | |
| 1874 | 5374 | 1799182 | 1799406 | 225 | | | | | | |
| 1875 | 5375 | 1799473 | 1800366 | 894 | | | | | | |
| 1876 | 5376 | 1800604 | 1800449 | 156 | | | | | | |
| 1877 | 5377 | 1800834 | 1801307 | 474 | | | | | | |
| 1878 | 5378 | 1801344 | 1802096 | 753 | | | | | | |
| 1879 | 5379 | 1802577 | 1802155 | 423 | | | | | | |
| 1880 | 5380 | 1802733 | 1803419 | 687 | | | | | | |
| 1881 | 5381 | 1803465 | 1803893 | 429 | | | | | | |
| 1882 | 5382 | 1804134 | 1804598 | 465 | | | | | | |
| 1883 | 5383 | 1804629 | 1804865 | 237 | | | | | | |
| 1884 | 5384 | 1804919 | 1805599 | 681 | | | | | | |
| 1885 | 5385 | 1805727 | 1806686 | 960 | | | | | | |
| 1886 | 5386 | 1806917 | 1807396 | 480 | | | | | | |
| 1887 | 5387 | 1807433 | 1808113 | 681 | | | | | | |
| 1888 | 5388 | 1808137 | 1808421 | 285 | | | | | | |
| 1889 | 5389 | 1808458 | 1808832 | 375 | | | | | | |
| 1890 | 5390 | 1809761 | 1810372 | 612 | sp: TNP2_ECOLI | Escherichia coli tnpR | 51.1 | 78.0 | 186 | transposon TN21 resolvase |
| 1891 | 5391 | 1810541 | 1811545 | 1005 | | | | | | |
| 1892 | 5392 | 1811564 | 1811938 | 375 | | | | | | |
| 1893 | 5393 | 1812215 | 1812691 | 477 | sp: PVH1_YEAST | Saccharomyces cerevisiae S288C YIR026C yvh1 | 29.3 | 51.8 | 164 | protein-tyrosine phosphatase |
| 1894 | 5394 | 1812881 | 1813606 | 726 | | | | | | |
| 1895 | 5395 | 1812882 | 1812460 | 423 | | | | | | |
| 1896 | 5396 | 1813780 | 1814517 | 738 | gp: SCA32WHIH_6 | Streptomyces coelicolor A3(2) whiH | 34.3 | 65.7 | 216 | sporulation transcription factor |
| 1897 | 5397 | 1814863 | 1815651 | 789 | | | | | | |
| 1898 | 5398 | 1815673 | 1816128 | 456 | | | | | | |
| 1899 | 5399 | 1816451 | 1816636 | 186 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1900 | 5400 | 1817132 | 1817803 | 672 | | | | | | |
| 1901 | 5401 | 1817803 | 1818219 | 417 | | | | | | |
| 1902 | 5402 | 1818460 | 1818774 | 315 | | | | | | |
| 1903 | 5403 | 1818798 | 1819166 | 369 | | | | | | |
| 1904 | 5404 | 1819954 | 1819748 | 207 | | | | | | |
| 1905 | 5405 | 1822382 | 1820181 | 2202 | pir: C72285 | Thermotoga maritima MSB8 TM1189 | 22.6 | 55.2 | 545 | hypothetical protein |
| 1906 | 5406 | 1822577 | 1824322 | 1746 | | | | | | |
| 1907 | 5407 | 1824371 | 1824589 | 219 | | | | | | |
| 1908 | 5408 | 1824784 | 1824927 | 144 | | | | | | |
| 1909 | 5409 | 1825606 | 1825178 | 429 | | | | | | |
| 1910 | 5410 | 1826024 | 1826557 | 534 | PIR: S60891 | Corynebacterium glutamicum | 63.0 | 75.0 | 166 | hypothetical protein |
| 1911 | 5411 | 1826644 | 1825751 | 894 | pir: S60890 | Corynebacterium glutamicum orf2 | 87.9 | 95.6 | 298 | insertion element (IS3 related) |
| 1912 | 5412 | 1826937 | 1826644 | 294 | pir: S60889 | Corynebacterium glutamicum orf1 | 72.3 | 84.2 | 101 | insertion element (IS3 related) |
| 1913 | 5413 | 1829900 | 1829688 | 213 | | | | | | |
| 1914 | 5414 | 1830765 | 1832063 | 1299 | | | | | | |
| 1915 | 5415 | 1832167 | 1834044 | 1878 | sp: RECJ_ERWCH | Erwinia chrysanthemi recJ | 24.0 | 50.6 | 622 | single-stranded-DNA-specific exonuclease |
| 1916 | 5416 | 1834928 | 1834149 | 780 | | | | | | |
| 1917 | 5417 | 1836675 | 1838324 | 1650 | pir: T13302 | Streptococcus phage phi-O1205 ORF13 | 31.8 | 64.3 | 381 | primase |
| 1918 | 5418 | 1838349 | 1842137 | 3789 | | | | | | |
| 1919 | 5419 | 1842235 | 1842681 | 447 | | | | | | |
| 1920 | 5420 | 1842804 | 1843337 | 534 | | | | | | |
| 1921 | 5421 | 1843518 | 1845356 | 1839 | sp: Y018_MYCPN | Mycoplasma pneumoniae ATCC 29342 yb95 | 22.1 | 44.7 | 620 | helicase |
| 1922 | 5422 | 1845483 | 1845857 | 375 | | | | | | |
| 1923 | 5423 | 1845872 | 1846207 | 336 | pir: T13144 | Bacteriophage N15 gene57 | 36.7 | 64.2 | 109 | phage N15 protein gp57 |
| 1924 | 5424 | 1846698 | 1846333 | 366 | | | | | | |
| 1925 | 5425 | 1847315 | 1847932 | 618 | | | | | | |
| 1926 | 5426 | 1847938 | 1848474 | 537 | | | | | | |
| 1927 | 5427 | 1848509 | 1849036 | 528 | | | | | | |
| 1928 | 5428 | 1848988 | 1849785 | 798 | | | | | | |
| 1929 | 5429 | 1849781 | 1849966 | 186 | | | | | | |
| 1930 | 5430 | 1850035 | 1850406 | 372 | | | | | | |
| 1931 | 5431 | 1850415 | 1849978 | 438 | | | | | | |
| 1932 | 5432 | 1851049 | 1850474 | 576 | | | | | | |
| 1933 | 5433 | 1851220 | 1852440 | 1221 | gp: SPAPJ760_2 | Schizosaccharomyces pombe SPAPJ760.02c | 28.7 | 49.8 | 422 | actin binding protein with SH3 domains |
| 1934 | 5434 | 1851473 | 1852324 | 852 | | | | | | |
| 1935 | 5435 | 1852479 | 1853873 | 1395 | | | | | | |
| 1936 | 5436 | 1854261 | 1854854 | 594 | | | | | | |
| 1937 | 5437 | 1855058 | 1855237 | 180 | | | | | | |
| 1938 | 5438 | 1855532 | 1856788 | 1257 | gp: SC5C7_14 | Streptomyces coelicolor SC5C7.14 | 23.6 | 52.5 | 347 | ATP/GTP binding protein |
| 1939 | 5439 | 1856885 | 1858738 | 1854 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1940 | 5440 | 1858763 | 1860727 | 1965 | sp: CLPA_ECOLI | Escherichia coli K12 clpA | 30.2 | 61.0 | 630 | ATP-dependent Clp proteinase ATP-binding subunit |
| 1941 | 5441 | 1860752 | 1861225 | 474 | | | | | | |
| 1942 | 5442 | 1861320 | 1861475 | 156 | | | | | | |
| 1943 | 5443 | 1861842 | 1861519 | 324 | | | | | | |
| 1944 | 5444 | 1862088 | 1862399 | 312 | | | | | | |
| 1945 | 5445 | 1862945 | 1865299 | 2355 | sp: PCRA_STAAU | Staphylococcus aureus SA20 pcrA | 21.4 | 45.9 | 693 | ATP-dependent helicase |
| 1946 | 5446 | 1865265 | 1865822 | 558 | | | | | | |
| 1947 | 5447 | 1865842 | 1866219 | 378 | | | | | | |
| 1948 | 5448 | 1866328 | 1866792 | 465 | | | | | | |
| 1949 | 5449 | 1866832 | 1867095 | 264 | | | | | | |
| 1950 | 5450 | 1867098 | 1867874 | 777 | gp: SCH17_7 | Streptomyces coelicolor A3(2) SCH17.07c | 25.9 | 47.8 | 224 | hypothetical protein |
| 1951 | 5451 | 1867886 | 1868587 | 702 | prf: 2514444Y | Bacteriophage phi-C31 gp52 | 31.7 | 61.5 | 208 | deoxynucleotide monophosphate kinase |
| 1952 | 5452 | 1868895 | 1868671 | 225 | | | | | | |
| 1953 | 5453 | 1871092 | 1868927 | 2166 | | | | | | |
| 1954 | 5454 | 1871373 | 1871101 | 273 | | | | | | |
| 1955 | 5455 | 1877886 | 1871380 | 6507 | | | | | | |
| 1956 | 5456 | 1878312 | 1879400 | 1089 | prf: 2403350A | Corynebacterium glutamicum ATCC 13032 cglIM | 99.2 | 99.7 | 363 | type II 5-cytosoine methyltransferase |
| 1957 | 5457 | 1879412 | 1880485 | 1074 | pir: A55225 | Corynebacterium glutamicum ATCC 13032 cglIR | 99.7 | 99.7 | 358 | type II restriction endonuclease |
| 1958 | 5458 | 1883990 | 1882470 | 1521 | | | | | | |
| 1959 | 5459 | 1884936 | 1884220 | 717 | | | | | | |
| 1960 | 5460 | 1885230 | 1887047 | 1818 | gp: SC1A2_16 | Streptomyces coelicolor A3(2) SC1A2.16c | 24.6 | 45.8 | 504 | hypothetical protein |
| 1961 | 5461 | 1887405 | 1887590 | 186 | | | | | | |
| 1962 | 5462 | 1888038 | 1887688 | 351 | gp: AE001973_4 | Deinococcus radiodurans DR1258 | 46.7 | 70.0 | 90 | SNF2/Rad54 helicase-related protein |
| 1963 | 5463 | 1889094 | 1888231 | 864 | pir: T13226 | Lactobacillus phage phi-gle Rorf232 | 33.1 | 56.4 | 163 | hypothetical protein |
| 1964 | 5464 | 1889530 | 1889859 | 330 | | | | | | |
| 1965 | 5465 | 1891707 | 1890028 | 1680 | gp: AF188935_16 | Bacillus anthracis pXO2-16 | 20.7 | 47.9 | 537 | hypothetical protein |
| 1966 | 5466 | 1893037 | 1891832 | 1206 | | | | | | |
| 1967 | 5467 | 1894680 | 1893388 | 1293 | | | | | | |
| 1968 | 5468 | 1897231 | 1894739 | 2493 | | | | | | |
| 1969 | 5469 | 1899158 | 1897374 | 1785 | sp: CLPB_ECOLI | Escherichia coli clpB | 25.3 | 52.5 | 724 | endopeptidase Clp ATP-binding chain B |
| 1970 | 5470 | 1899853 | 1899233 | 621 | | | | | | |
| 1971 | 5471 | 1900916 | 1899804 | 1113 | | | | | | |
| 1972 | 5472 | 1901911 | 1901066 | 846 | | | | | | |
| 1973 | 5473 | 1901975 | 1902955 | 981 | | | | | | |
| 1974 | 5474 | 1902883 | 1902005 | 879 | | | | | | |
| 1975 | 5475 | 1903028 | 1903225 | 198 | | | | | | |
| 1976 | 5476 | 1905878 | 1903113 | 2766 | pir: S23647 | Homo sapiens numA | 20.1 | 49.1 | 1004 | nuclear mitotic apparatus protein |
| 1977 | 5477 | 1906572 | 1905973 | 600 | | | | | | |
| 1978 | 5478 | 1907914 | 1906664 | 1251 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 1979 | 5479 | 1908660 | 1907965 | 696 | | | | | | |
| 1980 | 5480 | 1909498 | 1908785 | 714 | | | | | | |
| 1981 | 5481 | 1910508 | 1909501 | 1008 | | | | | | |
| 1982 | 5482 | 1912300 | 1910642 | 1659 | | | | | | |
| 1983 | 5483 | 1913820 | 1912333 | 1488 | | | | | | |
| 1984 | 5484 | 1914371 | 1913973 | 399 | | | | | | |
| 1985 | 5485 | 1916233 | 1914725 | 1509 | | | | | | |
| 1986 | 5486 | 1916374 | 1916733 | 360 | | | | | | |
| 1987 | 5487 | 1916944 | 1917165 | 222 | | | | | | |
| 1988 | 5488 | 1917640 | 1917329 | 312 | | | | | | |
| 1989 | 5489 | 1918208 | 1917564 | 645 | | | | | | |
| 1990 | 5490 | 1919461 | 1918703 | 759 | | | | | | |
| 1991 | 5491 | 1920194 | 1919646 | 549 | | | | | | |
| 1992 | 5492 | 1921276 | 1920347 | 930 | | | | | | |
| 1993 | 5493 | 1925390 | 1925695 | 306 | | | | | | |
| 1994 | 5494 | 1925682 | 1926038 | 357 | | | | | | |
| 1995 | 5495 | 1926010 | 1921547 | 4464 | pir: T03099 | Sus scrofa domestica | 23.2 | 49.2 | 1408 | submaxillary apomucin |
| 1996 | 5496 | 1926837 | 1926259 | 579 | | | | | | |
| 1997 | 5497 | 1928189 | 1927245 | 945 | | | | | | |
| 1998 | 5498 | 1928211 | 1928381 | 171 | sp: MTE1_ECOLI | Escherichia coli ecoR1 | 42.6 | 65.6 | 61 | modification methylase |
| 1999 | 5499 | 1928534 | 1928908 | 375 | | | | | | |
| 2000 | 5500 | 1930879 | 1929059 | 1821 | | | | | | |
| 2001 | 5501 | 1931190 | 1930990 | 201 | | | | | | |
| 2002 | 5502 | 1931888 | 1931421 | 468 | pir: H70638 | Mycobacterium tuberculosis H37Rv Rv1956 | 38.6 | 58.8 | 114 | hypothetical protein |
| 2003 | 5503 | 1932315 | 1931935 | 381 | | | | | | |
| 2004 | 5504 | 1932879 | 1932373 | 507 | | | | | | |
| 2005 | 5505 | 1934358 | 1933522 | 837 | | | | | | |
| 2006 | 5506 | 1935912 | 1934971 | 942 | sp: Y137_METJA | Methanococcus jannaschii MJ0137 | 27.1 | 54.6 | 328 | hypothetical protein |
| 2007 | 5507 | 1936226 | 1936849 | 624 | | | | | | |
| 2008 | 5508 | 1937202 | 1937411 | 210 | | | | | | |
| 2009 | 5509 | 1938019 | 1937486 | 534 | | | | | | |
| 2010 | 5510 | 1938945 | 1940135 | 1191 | | | | | | |
| 2011 | 5511 | 1939064 | 1938531 | 534 | | | | | | |
| 2012 | 5512 | 1940257 | 1940844 | 588 | | | | | | |
| 2013 | 5513 | 1941107 | 1941550 | 444 | | | | | | |
| 2014 | 5514 | 1942484 | 1941732 | 753 | | | | | | |
| 2015 | 5515 | 1942510 | 1942812 | 303 | | | | | | |
| 2016 | 5516 | 1943095 | 1943310 | 216 | | | | | | |
| 2017 | 5517 | 1943345 | 1943653 | 309 | | | | | | |
| 2018 | 5518 | 1943680 | 1944564 | 885 | | | | | | |
| 2019 | 5519 | 1945435 | 1944608 | 828 | prf: 2509434A | Enterococcus faecalis esp | 23.0 | 44.1 | 304 | surface protein |
| 2020 | 5520 | 1945891 | 1945595 | 297 | | | | | | |
| 2021 | 5521 | 1946332 | 1945952 | 381 | | | | | | |
| 2022 | 5522 | 1947037 | 1946609 | 429 | | | | | | |
| 2023 | 5523 | 1948650 | 1947070 | 1581 | sp: CSP1_CORGL | Corynebacterium glutamicum (Brevibacterium flavum) ATCC 17965 csp1 | 30.7 | 54.4 | 270 | major secreted protein PS1 protein precursor |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2024 | 5524 | 1951450 | 1949021 | 2430 | | | | | | |
| 2025 | 5525 | 1952485 | 1951619 | 867 | | | | | | |
| 2026 | 5526 | 1954822 | 1952546 | 2277 | sp: TOP3_ECOLI | Escherichia coli topB | 23.8 | 50.9 | 597 | DNA topoisomerase III |
| 2027 | 5527 | 1958287 | 1956203 | 2085 | | | | | | |
| 2028 | 5528 | 1959340 | 1958450 | 891 | | | | | | |
| 2029 | 5529 | 1960196 | 1959765 | 432 | | | | | | |
| 2030 | 5530 | 1961114 | 1960371 | 744 | | | | | | |
| 2031 | 5531 | 1963000 | 1961114 | 1887 | sp: CSP1_CORGL | Corynebacterium glutamicum (Brevibacterium flavum) ATCC 17965 csp1 | 29.7 | 54.7 | 344 | major secreted protein PS1 protein precursor |
| 2032 | 5532 | 1963429 | 1963139 | 291 | | | | | | |
| 2033 | 5533 | 1964743 | 1963514 | 1230 | | | | | | |
| 2034 | 5534 | 1965902 | 1964727 | 1176 | | | | | | |
| 2035 | 5535 | 1966267 | 1965911 | 357 | | | | | | |
| 2036 | 5536 | 1966301 | 1966984 | 684 | sp: NUC_STAAU | Staphylococcus aureus nuc | 30.4 | 57.7 | 227 | thermonuclease |
| 2037 | 5537 | 1967435 | 1967289 | 147 | | | | | | |
| 2038 | 5538 | 1967604 | 1968167 | 564 | | | | | | |
| 2039 | 5539 | 1968264 | 1969715 | 1452 | | | | | | |
| 2040 | 5540 | 1969745 | 1970203 | 459 | | | | | | |
| 2041 | 5541 | 1970254 | 1971474 | 1221 | | | | | | |
| 2042 | 5542 | 1971672 | 1973090 | 1419 | | | | | | |
| 2043 | 5543 | 1973147 | 1973737 | 591 | | | | | | |
| 2044 | 5544 | 1973809 | 1974204 | 396 | | | | | | |
| 2045 | 5545 | 1974267 | 1974503 | 237 | | | | | | |
| 2046 | 5546 | 1975171 | 1975794 | 624 | prf: 2313347B | Shewanella sp. ssb | 24.9 | 59.1 | 225 | single stranded DNA-binding protein |
| 2047 | 5547 | 1975916 | 1976494 | 579 | | | | | | |
| 2048 | 5548 | 1976522 | 1976983 | 462 | | | | | | |
| 2049 | 5549 | 1977043 | 1977549 | 507 | | | | | | |
| 2050 | 5550 | 1977742 | 1978329 | 588 | | | | | | |
| 2051 | 5551 | 1978389 | 1978721 | 333 | | | | | | |
| 2052 | 5552 | 1978660 | 1979217 | 558 | | | | | | |
| 2053 | 5553 | 1979239 | 1979808 | 570 | | | | | | |
| 2054 | 5554 | 1979974 | 1980885 | 912 | sp: S24D_ANOGA | Anopheles gambiae AgSP24D | 25.7 | 52.6 | 249 | serine protease |
| 2055 | 5555 | 1980965 | 1981657 | 693 | | | | | | |
| 2056 | 5556 | 1981663 | 1982028 | 366 | | | | | | |
| 2057 | 5557 | 1982071 | 1982817 | 747 | | | | | | |
| 2058 | 5558 | 1982091 | 1981912 | 180 | | | | | | |
| 2059 | 5559 | 1983186 | 1983548 | 363 | | | | | | |
| 2060 | 5560 | 1983611 | 1983883 | 273 | | | | | | |
| 2061 | 5561 | 1983918 | 1984181 | 264 | | | | | | |
| 2062 | 5562 | 1984217 | 1984450 | 234 | | | | | | |
| 2063 | 5563 | 1984387 | 1984728 | 342 | | | | | | |
| 2064 | 5564 | 1985092 | 1985364 | 273 | | | | | | |
| 2065 | 5565 | 1985373 | 1985071 | 303 | | | | | | |
| 2066 | 5566 | 1986590 | 1985442 | 1149 | sp: VINT_BPML5 | Mycobacterium phage L5 int | 29.6 | 55.9 | 406 | integrase |
| 2067 | 5567 | 1987896 | 1987507 | 390 | gsp: R23011 | Brevibacterium lactofermentum CGL2005 ISaB1 | 83.9 | 94.4 | 124 | transposase (divided) |
| 2068 | 5568 | 1988303 | 1987887 | 417 | gsp: R23011 | Brevibacterium lactofermentum CGL2005 ISaB1 | 70.9 | 84.6 | 117 | transposase (divided) |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2069 | 5569 | 1988383 | 1988589 | 207 | gsp: R21601 | *Brevibacterium lactofermentum* CGL2005 ISaB1 | 80.7 | 96.8 | 31 | transposition repressor |
| 2070 | 5570 | 1988483 | 1988370 | 114 | | | | | | |
| 2071 | 5571 | 1988664 | 1988530 | 135 | pir: S60889 | *Corynebacterium glutamicum* orf1 | 74.4 | 88.4 | 43 | insertion element (IS3 related) |
| 2072 | 5572 | 1989605 | 1988778 | 828 | gsp: SCJ11_12 | *Streptomyces coelicolor* A3(2) SCJ11.12 | 31.1 | 53.7 | 270 | transposase |
| 2073 | 5573 | 1990667 | 1991020 | 354 | | | | | | |
| 2074 | 5574 | 1990764 | 1989874 | 891 | | | | | | |
| 2075 | 5575 | 1991620 | 1991189 | 432 | | | | | | |
| 2076 | 5576 | 1992538 | 1991795 | 744 | | | | | | |
| 2077 | 5577 | 1994121 | 1992538 | 1584 | sp: CSP1_CORGL | *Corynebacterium glutamicum* (*Brevibacterium flavum*) ATCC 17965 csp1 | 25.0 | 37.0 | 153 | major secreted protein PS1 protein precursor |
| 2078 | 5578 | 1995294 | 1994608 | 687 | sp: VINT_BPML5 | *Mycobacterium phage* L5 int | 28.7 | 56.1 | 223 | integrase |
| 2079 | 5579 | 1996088 | 1995783 | 306 | pir: F64546 | *Helicobacter pylori* 26695 HP0214 | 39.8 | 76.1 | 88 | sodium-dependent transporter |
| 2080 | 5580 | 1996106 | 1996537 | 432 | sp: YXAA_BACSU | *Bacillus subtilis* yxaA | 48.9 | 81.5 | 92 | hypothetical protein |
| 2081 | 5581 | 1996768 | 1997112 | 345 | | | | | | |
| 2082 | 5582 | 1997168 | 1997503 | 336 | | | | | | |
| 2083 | 5583 | 1997545 | 1998240 | 696 | pir: C70968 | *Mycobacterium tuberculosis* H37Rv Rv2671 ribD | 33.5 | 64.4 | 233 | riboflavin biosynthesis protein |
| 2084 | 5584 | 1998289 | 1999542 | 1254 | pir: E70968 | *Mycobacterium tuberculosis* H37Rv Rv2673 | 42.5 | 71.9 | 384 | potential membrane protein |
| 2085 | 5585 | 1999542 | 1999949 | 408 | gp: AF128264_2 | *Streptococcus gordonii* msrA | 41.3 | 67.5 | 126 | methionine sulfoxide reductase |
| 2086 | 5586 | 2000132 | 1999707 | 426 | | | | | | |
| 2087 | 5587 | 2001216 | 2000521 | 696 | pir: H70968 | *Mycobacterium tuberculosis* H37Rv Rv2676c | 55.2 | 77.2 | 232 | hypothetical protein |
| 2088 | 5588 | 2001489 | 2002112 | 624 | pir: C70528 | *Mycobacterium tuberculosis* H37Rv Rv2680 | 55.7 | 78.6 | 201 | hypothetical protein |
| 2089 | 5589 | 2002072 | 2003334 | 1263 | sp: RND_HAEIN | *Haemophilus influenzae* Rd KW20 HI0390 rnd | 25.9 | 52.8 | 371 | ribonuclease D |
| 2090 | 5590 | 2005309 | 2003402 | 1908 | gp: AB026631_1 | *Streptomyces* sp. CL190 dxs | 55.3 | 78.5 | 618 | 1-deoxy-D-xylulose-5-phosphate synthase |
| 2091 | 5591 | 2006697 | 2005462 | 1236 | pir: E72298 | *Thermotoga maritima* MSB8 TM1094 | 25.4 | 52.3 | 472 | RNA methyltransferase |
| 2092 | 5592 | 2006698 | 2006979 | 282 | pir: C70530 | *Mycobacterium tuberculosis* H37Rv Rv2696c | 38.1 | 62.7 | 268 | hypothetical protein |
| 2093 | 5593 | 2007637 | 2006777 | 861 | | | | | | |
| 2094 | 5594 | 2008184 | 2007738 | 447 | sp: DUT_STRCO | *Streptomyces coelicolor* A3(2) SC2E9.09 dut | 55.0 | 82.1 | 140 | deoxyuridine 5′-triphosphate nucleotidohydrolase |
| 2095 | 5595 | 2008250 | 2008798 | 549 | pir: E70530 | *Mycobacterium tuberculosis* H37Rv Rv2698 | 46.0 | 70.7 | 150 | hypothetical protein |
| 2096 | 5596 | 2009082 | 2008876 | 207 | | | | | | |
| 2097 | 5597 | 2009570 | 2009280 | 291 | pir: F70530 | *Mycobacterium tuberculosis* H37Rv Rv2699c | 58.0 | 81.0 | 100 | hypothetical protein |
| 2098 | 5598 | 2010539 | 2009724 | 816 | sp: SUHB_ECOLI | *Escherichia coli* K12 suhB | 38.4 | 68.2 | 198 | extragenic suppressor protein |
| 2099 | 5599 | 2010555 | 2011382 | 828 | sp: PPGK_MYCTU | *Mycobacterium tuberculosis* H37Rv RV2702 ppgK | 54.4 | 80.2 | 248 | polyphosphate glucokinase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2100 | 5600 | 2011863 | 2013356 | 1494 | prf: 2204286A | Corynebacterium glutamicum sigA | 98.0 | 98.6 | 500 | sigma factor or RNA polymerase transcription factor |
| 2101 | 5601 | 2015496 | 2014162 | 1335 | sp: YRKO_BACSU | Bacillus subtilis yrkO | 23.9 | 51.4 | 422 | hypothetical membrane protein |
| 2102 | 5602 | 2016121 | 2015585 | 537 | | | | | | |
| 2103 | 5603 | 2017966 | 2016257 | 1710 | sp: Y065_MYCTU | Mycobacterium tuberculosis H37Rv Rv2917 | 61.3 | 80.8 | 578 | hypothetical protein |
| 2104 | 5604 | 2018119 | 2018754 | 636 | pir: H70531 | Mycobacterium tuberculosis H37Rv Rv2709 | 32.3 | 59.1 | 127 | hypothetical membrane protein |
| 2105 | 5605 | 2018202 | 2017966 | 237 | pir: G70531 | Mycobacterium tuberculosis H37Rv Rv2708c | 65.8 | 85.5 | 76 | hypothetical protein |
| 2106 | 5606 | 2018744 | 2020276 | 1533 | gp: SCH5_8 | Streptomyces coelicolor A3(2) SCH5.08c | 33.5 | 61.2 | 523 | transferase |
| 2107 | 5607 | 2020293 | 2020724 | 432 | prf: 2204286C | Corynebacterium glutamicum ATCC 13869 ORF1 | 97.2 | 100.0 | 144 | hypothetical protein |
| 2108 | 5608 | 2022266 | 2022949 | 684 | pir: I40339 | Corynebacterium glutamicum ATCC 13869 dtxR | 98.7 | 99.6 | 228 | iron dependent repressor or diphtheria toxin repressor |
| 2109 | 5609 | 2022546 | 2022313 | 234 | GP: AF010134_1 | Streptomyces aureofaciens | 62.0 | 64.0 | 77 | putative sporulation protein |
| 2110 | 5610 | 2022959 | 2023945 | 987 | sp: GALE_BRELA | Corynebacterium glutamicum ATCC 13869 (Brevibacterium lactofermentum) galE | 99.1 | 99.1 | 329 | UDP-glucose 4-epimerase |
| 2111 | 5611 | 2025270 | 2023948 | 1323 | pir: E70532 | Mycobacterium tuberculosis H37Rv Rv2714 | 45.3 | 79.0 | 305 | hypothetical protein |
| 2112 | 5612 | 2025423 | 2026379 | 957 | | | | | | |
| 2113 | 5613 | 2026494 | 2029043 | 2550 | sp: MTR4_YEAST | Saccharomyces cerevisiae YJL050W dob1 | 24.4 | 50.7 | 661 | ATP-dependent RNA helicase |
| 2114 | 5614 | 2029177 | 2030157 | 981 | sp: OXYR_ECOLI | Escherichia coli oxyR | 35.8 | 65.6 | 299 | hydrogen peroxide-inducible genes activator |
| 2115 | 5615 | 2031365 | 2030277 | 1089 | sp: HRPA_ECOLI | Escherichia coli hrpA | 49.2 | 76.2 | 1298 | ATP-dependent helicase |
| 2116 | 5616 | 2031478 | 2035383 | 3906 | gp: SCAJ4870_3 | Streptomyces clavuligerus nrdR | 61.4 | 86.2 | 145 | regulatory protein |
| 2117 | 5617 | 2035880 | 2035431 | 450 | | | | | | |
| 2118 | 5618 | 2036409 | 2035990 | 420 | | | | | | |
| 2119 | 5619 | 2036812 | 2037507 | 696 | sp: LEXA_BACSU | Bacillus subtilis dinR | 46.9 | 71.6 | 222 | SOS regulatory protein |
| 2120 | 5620 | 2037815 | 2038591 | 777 | sp: GATR_ECOLI | Escherichia coli K12 gatR | 33.9 | 67.8 | 245 | galactitol utilization operon repressor |
| 2121 | 5621 | 2038591 | 2039550 | 960 | gp: SCE22_14 | Streptomyces coelicolor A3(2) SCE22.14c | 27.2 | 55.6 | 320 | phosphofructokinase (fructose 1-phosphate kinase) |
| 2122 | 5622 | 2041321 | 2039618 | 1704 | sp: PT1_BACST | Bacillus stearothermophilus ptsI | 34.3 | 64.0 | 592 | phosphoenolpyruvate-protein phosphotransferase |
| 2123 | 5623 | 2041728 | 2042519 | 792 | sp: GLPR_ECOLI | Escherichia coli K12 glpR | 26.7 | 62.6 | 262 | glycerol-3-phosphate regulon repressor |
| 2124 | 5624 | 2042519 | 2043508 | 990 | sp: K1PF_RHOCA | Rhodobacter capsulatus fruK | 33.0 | 55.7 | 345 | 1-phosphofructokinase or 6-phosphofructokinase |
| 2125 | 5625 | 2043736 | 2045571 | 1836 | sp: PTFB_ECOLI | Escherichia coli K12 fruA | 43.0 | 69.6 | 549 | PTS system, fructose-specific IIBC component |
| 2126 | 5626 | 2045762 | 2046028 | 267 | sp: PTHP_BACST | Bacillus stearothermophilus XL-65-6 ptsH | 37.0 | 71.6 | 81 | phosphocarrier protein |
| 2127 | 5627 | 2047295 | 2046714 | 582 | | | | | | |
| 2128 | 5628 | 2048606 | 2047320 | 1287 | sp: PYRP_BACCL | Bacillus caldolyticus pyrP | 39.1 | 70.5 | 407 | uracil permease |
| 2129 | 5629 | 2050107 | 2048650 | 1458 | gp: AF145049_8 | Streptomyces fradiae orfl1* | 54.4 | 80.0 | 419 | ATP/GTP-binding protein |
| 2130 | 5630 | 2050321 | 2051106 | 786 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2131 | 5631 | 2051306 | 2051842 | 537 | | | | | | |
| 2132 | 5632 | 2052675 | 2051845 | 831 | sp: DAPF_HAEIN | Haemophilus influenzae Rd KW20 HI0750 dapF | 33.5 | 64.7 | 269 | diaminopimelate epimerase |
| 2133 | 5633 | 2053586 | 2052684 | 903 | sp: MIAA_ECOLI | Escherichia coli K12 miaA | 40.0 | 68.7 | 300 | tRNA delta-2-isopentenylpyrophosphate transferase |
| 2134 | 5634 | 2054283 | 2053609 | 675 | | | | | | |
| 2135 | 5635 | 2054403 | 2055761 | 1359 | pir: B70506 | Mycobacterium tuberculosis H37Rv Rv2731 | 48.5 | 75.7 | 445 | hypothetical protein |
| 2136 | 5636 | 2055743 | 2054724 | 1020 | | | | | | |
| 2137 | 5637 | 2055765 | 2056787 | 1023 | | | | | | |
| 2138 | 5638 | 2057788 | 2057120 | 669 | pir: C70506 | Mycobacterium tuberculosis H37Rv Rv2732c | 29.0 | 63.7 | 190 | hypothetical membrane protein |
| 2139 | 5639 | 2059420 | 2057855 | 1566 | sp: Y195_MYCLE | Mycobacterium leprae B2235_C2_195 | 68.4 | 86.4 | 494 | hypothetical protein |
| 2140 | 5640 | 2059774 | 2060499 | 726 | sp: GLUA_CORGL | Corynebacterium glutamicum ATCC 13032 gluA | 99.6 | 99.6 | 242 | glutamate transport ATP-binding protein |
| 2141 | 5641 | 2060414 | 2060196 | 219 | GSP: Y75358 | Neisseria gonorrhoeae | 66.0 | 73.0 | 71 | Neisserial polypeptides predicted to be useful antigens for vaccines and diagnostics |
| 2142 | 5642 | 2061629 | 2062312 | 684 | sp: GLUC_CORGL | Corynebacterium glutamicum ATCC 13032 gluC | 100.0 | 100.0 | 225 | glutamate transport system permease protein |
| 2143 | 5643 | 2062441 | 2063259 | 819 | sp: GLUD_CORGL | Corynebacterium glutamicum (Brevibacterium flavum) ATCC 13032 gluD | 99.3 | 99.6 | 273 | glutamate transport system permease protein |
| 2144 | 5644 | 2063894 | 2063298 | 597 | sp: RECX_MYCLE | Mycobacterium leprae recX | 34.5 | 66.9 | 142 | regulatory protein |
| 2145 | 5645 | 2065627 | 2065394 | 234 | pir: A70878 | Mycobacterium tuberculosis H37Rv Rv2738c | 40.3 | 71.6 | 67 | hypothetical protein |
| 2146 | 5646 | 2066404 | 2065667 | 738 | | | | | | |
| 2147 | 5647 | 2066566 | 2067141 | 576 | sp: BIOY_BACSH | Bacillus sphaericus bioY | 33.0 | 61.4 | 197 | biotin synthase |
| 2148 | 5648 | 2067168 | 2067866 | 699 | sp: POTG_ECOLI | Escherichia coli K12 potG | 33.2 | 69.5 | 223 | putrescine transport ATP-binding protein |
| 2149 | 5649 | 2067866 | 2068474 | 609 | pir: F69742 | Bacillus subtilis ybaF | 24.6 | 58.8 | 228 | hypothetical membrane protein |
| 2150 | 5650 | 2068703 | 2069392 | 690 | pir: B60176 | Mycobacterium tuberculosis H37Rv Rv2744c | 41.7 | 78.5 | 228 | hypothetical protein |
| 2151 | 5651 | 2069383 | 2068556 | 828 | sp: 35KD_MYCTU | Mycobacterium tuberculosis H37Rv Rv2744C | 72.5 | 89.6 | 269 | hypothetical protein (35 kD protein) |
| 2152 | 5652 | 2069936 | 2069616 | 321 | pir: H70878 | Mycobacterium tuberculosis H37Rv Rv2745c | 54.2 | 78.3 | 83 | regulator (DNA-binding protein) |
| 2153 | 5653 | 2070512 | 2069997 | 516 | sp: CINA_STRPN | Streptococcus pneumoniae R6X cinA | 41.8 | 68.5 | 165 | competence damage induced proteins |
| 2154 | 5654 | 2071121 | 2070519 | 603 | prf: 2421334D | Streptococcus pyogenes pgsA | 38.8 | 72.5 | 160 | phosphotidylglycerophosphate synthase |
| 2155 | 5655 | 2071315 | 2071599 | 285 | pir: T10688 | Arabidopsis thaliana ATSP: T16I18.20 | 24.8 | 52.1 | 117 | hypothetical protein |
| 2156 | 5656 | 2071624 | 2071740 | 117 | gp: AF071810_1 | Streptococcus pneumoniae DBL5 pspA | 60.0 | 70.0 | 30 | surface protein (Pneumococcal surface protein A) |
| 2157 | 5657 | 2072066 | 2072878 | 813 | | | | | | |
| 2158 | 5658 | 2072905 | 2071799 | 1107 | prf: 2119295D | Escherichia coli terC | 31.0 | 59.8 | 358 | tellurite resistance protein |
| 2159 | 5659 | 2076056 | 2073294 | 2763 | sp: SP3E_BACSU | Bacillus subtilis 168 spoIIIE | 38.0 | 64.6 | 845 | stage III sporulation protein E |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2160 | 5660 | 2077024 | 2076392 | 633 | gp: SC4G6_14 | Streptomyces coelicolor A3(2) SC4G6.14 | 33.3 | 61.0 | 216 | hypothetical protein |
| 2161 | 5661 | 2079275 | 2077122 | 2154 | sp: YOR4_CORGL | Corynebacterium glutamicum ATCC 13032 orf4 | 99.1 | 99.4 | 645 | hypothetical protein |
| 2162 | 5662 | 2081136 | 2080387 | 750 | sp: YDAP_BRELA | Corynebacterium glutamicum (Brevibacterium lactofermentum) ATCC 13869 orf2 | 99.2 | 99.6 | 250 | hypothetical protein |
| 2163 | 5663 | 2082115 | 2082813 | 699 | | | | | | |
| 2164 | 5664 | 2082368 | 2082105 | 264 | | | | | | |
| 2165 | 5665 | 2085190 | 2082932 | 2259 | prf: 2217311A | Streptomyces antibioticus gpsI | 65.4 | 85.3 | 742 | guanosine pentaphosphate synthetase |
| 2166 | 5666 | 2085702 | 2085436 | 267 | pir: F69700 | Bacillus subtilis rpsO | 64.0 | 88.8 | 89 | 30S ribosomal protein S15 |
| 2167 | 5667 | 2086826 | 2085879 | 948 | prf: 2518365A | Leishmania major | 35.1 | 63.3 | 319 | nucleoside hydrolase |
| 2168 | 5668 | 2087941 | 2086919 | 1023 | sp: RIBF_CORAM | Corynebacterium ammoniagenes ATCC 6872 ribF | 56.2 | 79.0 | 329 | bifunctional protein (riboflavin kinase and FAD synthetase) |
| 2169 | 5669 | 2087973 | 2088863 | 891 | sp: TRUB_BACSU | Bacillus subtilis 168 truB | 32.7 | 61.7 | 303 | tRNA pseudouridine synthase B |
| 2170 | 5670 | 2088181 | 2087954 | 228 | PIR: PC4007 | Corynebacterium ammoniagenes | 65.0 | 73.0 | 47 | hypothetical protein |
| 2171 | 5671 | 2089868 | 2089218 | 651 | gp: SC5A7_23 | Streptomyces coelicolor A3(2) SC5A7.23 | 42.2 | 62.5 | 237 | hypothetical protein |
| 2172 | 5672 | 2090664 | 2089861 | 804 | pir: B70885 | Mycobacterium tuberculosis H37Rv Rv2795c | 46.9 | 68.9 | 273 | phosphoesterase |
| 2173 | 5673 | 2092055 | 2090751 | 1305 | pir: G70693 | Mycobacterium tuberculosis H37Rv Rv2836c dinF | 51.0 | 78.8 | 433 | DNA damaged inducible protein f |
| 2174 | 5674 | 2093046 | 2092051 | 996 | pir: H70693 | Mycobacterium tuberculosis H37Rv Rv2837c | 36.7 | 70.8 | 308 | hypothetical protein |
| 2175 | 5675 | 2093501 | 2093055 | 447 | sp: RBFA_BACSU | Bacillus subtilis 168 rbfA | 32.4 | 70.4 | 108 | ribosome-binding factor A |
| 2176 | 5676 | 2096723 | 2093712 | 3012 | sp: IF2_STIAU | Stigmatella aurantiaca DW4 infB | 37.7 | 62.9 | 1103 | translation initiation factor IF-2 |
| 2177 | 5677 | 2097179 | 2096844 | 336 | gp: SC5H4_29 | Streptomyces coelicolor A3(2) SC5H4.29 | 44.6 | 66.3 | 83 | hypothetical protein |
| 2178 | 5678 | 2098375 | 2097380 | 996 | sp: NUSA_BACSU | Bacillus subtilis nusA | 42.3 | 71.0 | 352 | n-utilization substance protein (transcriptional termination/antitermination factor) |
| 2179 | 5679 | 2098562 | 2099815 | 1254 | | | | | | |
| 2180 | 5680 | 2098945 | 2098412 | 534 | pir: E70588 | Mycobacterium tuberculosis H37Rv Rv2842c | 34.6 | 65.5 | 165 | hypothetical protein |
| 2181 | 5681 | 2100240 | 2101841 | 1602 | sp: DPPE_BACSU | Bacillus subtilis 168 dppE | 25.3 | 60.9 | 534 | peptide-binding protein |
| 2182 | 5682 | 2102023 | 2102946 | 924 | sp: DPPB_ECOLI | Escherichia coli K12 dppB | 37.7 | 69.4 | 337 | peptidetransport system permease |
| 2183 | 5683 | 2102975 | 2103973 | 999 | prf: 1709239C | Bacillus subtilis spo0KC | 38.4 | 69.2 | 292 | oligopeptide permease |
| 2184 | 5684 | 2103973 | 2105703 | 1731 | pir: H70788 | Mycobacterium tuberculosis H37Rv Rv3663c dppD | 57.6 | 81.3 | 552 | peptidetransport system ABC-transporter ATP-binding protein |
| 2185 | 5685 | 2107564 | 2105801 | 1764 | sp: SYP_MYCTU | Mycobacterium tuberculosis H37Rv Rv2845c proS | 67.0 | 84.6 | 578 | prolyl-tRNA synthetase |
| 2186 | 5686 | 2107652 | 2108386 | 735 | gp: SCC30_5 | Streptomyces coelicolor A3(2) SCC30.05 | 39.5 | 65.0 | 243 | hypothetical protein |
| 2187 | 5687 | 2109147 | 2108389 | 759 | sp: BCHD_RHOSH | Rhodobacter sphaeroides ATCC 17023 bchD | 32.4 | 60.7 | 37 | magnesium-chelatase subunit |
| 2188 | 5688 | 2110255 | 2109155 | 1101 | prf: 250462AA | Heliobacillus mobilis bchI | 46.5 | 69.6 | 342 | magnesium-chelatase subunit |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2189 | 5689 | 2111183 | 2110434 | 750 | prf: 2108318B | *Propionibacterium freudenreichii* cobA | 49.0 | 73.8 | 237 | uroporphyrinogen III methyltransferase |
| 2190 | 5690 | 2111238 | 2112659 | 1422 | sp: YPLC_CLOPE | *Clostridium perfringens* NCIB 10662 ORF2 | 41.2 | 68.7 | 488 | hypothetical protein |
| 2191 | 5691 | 2113616 | 2112717 | 900 | gp: SC5H1_10 | *Streptomyces coelicolor* A3(2) SC5H1.10c | 35.1 | 62.3 | 151 | hypothetical protein |
| 2192 | 5692 | 2115761 | 2116774 | 1014 | pir: A70590 | *Mycobacterium tuberculosis* H37Rv Rv2854 | 37.6 | 65.7 | 338 | hypothetical protein |
| 2193 | 5693 | 2116916 | 2118310 | 1395 | sp: GSHR_BURCE | *Burkholderia cepacia* AC1100 gor | 53.0 | 76.6 | 466 | glutathione reductase |
| 2194 | 5694 | 2117956 | 2117015 | 942 | | | | | | |
| 2195 | 5695 | 2118607 | 2119080 | 474 | | | | | | |
| 2196 | 5696 | 2119139 | 2119495 | 357 | | | | | | |
| 2197 | 5697 | 2119628 | 2120356 | 729 | | | | | | |
| 2198 | 5698 | 2121147 | 2120359 | 789 | sp: AMPM_ECOLI | *Escherichia coli* K12 map | 47.2 | 75.8 | 252 | methionine aminopeptidase |
| 2199 | 5699 | 2123161 | 2121296 | 1866 | prf: 2224268A | *Streptomyces clavuligerus* pcbR | 27.3 | 56.5 | 630 | penicillin binding protein |
| 2200 | 5700 | 2123848 | 2123219 | 630 | prf: 2518330B | *Corynebacterium diphtheriae* chrA | 44.0 | 72.2 | 216 | response regulator (two-component system response regulator) |
| 2201 | 5701 | 2124996 | 2123848 | 1149 | prf: 2518330A | *Corynebacterium diphtheriae* chrS | 29.5 | 56.8 | 424 | two-component system sensor histidine kinase |
| 2202 | 5702 | 2125089 | 2126045 | 957 | gp: AE001863_70 | *Deinococcus radiodurans* DRA0279 | 24.4 | 58.1 | 360 | hypothetical membrane protein |
| 2203 | 5703 | 2126064 | 2126753 | 690 | prf: 2420410P | *Bacillus subtilis* 168 yvrO | 37.3 | 71.1 | 225 | ABC transporter |
| 2204 | 5704 | 2127087 | 2126926 | 162 | | | | | | |
| 2205 | 5705 | 2128483 | 2127350 | 1134 | sp: GCPE_ECOLI | *Escherichia coli* K12 gcpE | 44.3 | 73.8 | 359 | hypothetical protein (gcpE protein) |
| 2206 | 5706 | 2128850 | 2129461 | 612 | | | | | | |
| 2207 | 5707 | 2129880 | 2128669 | 1212 | pir: G70886 | *Mycobacterium tuberculosis* H37Rv Rv2869c | 43.0 | 73.6 | 405 | hypothetical membrane protein |
| 2208 | 5708 | 2130306 | 2130950 | 645 | GSP: Y37145 | *Chlamydia trachomatis* | 36.0 | 43.0 | 147 | polypeptides can be used as vaccines against Chlamydia trachomatis |
| 2209 | 5709 | 2131078 | 2129903 | 1176 | sp: DXR_ECOLI | *Escherichia coli* K12 dxr | 22.8 | 42.0 | 312 | 1-deoxy-D-xylulose-5-phosphate reductoisomerase |
| 2210 | 5710 | 2131322 | 2131762 | 441 | | | | | | |
| 2211 | 5711 | 2131726 | 2131247 | 480 | | | | | | |
| 2212 | 5712 | 2133402 | 2131825 | 1578 | | | | | | |
| 2213 | 5713 | 2134260 | 2133406 | 855 | pir: B72334 | *Thermotoga maritima* MSB8 TM0793 | 37.1 | 75.1 | 245 | ABC transporter ATP-binding protein |
| 2214 | 5714 | 2135551 | 2134454 | 1098 | sp: YS80_MYCTU | *Mycobacterium tuberculosis* H37Rv | 66.0 | 78.0 | 356 | pyruvate formate-lyase 1 activating enzyme |
| 2215 | 5715 | 2135884 | 2136141 | 258 | pir: A70801 | *Mycobacterium tuberculosis* H37Rv Rv3760 | 41.5 | 74.5 | 94 | hypothetical membrane protein |
| 2216 | 5716 | 2137089 | 2136235 | 855 | sp: CDSA_PSEAE | *Pseudomonas aeruginosa* ATCC 15692 cdsA | 33.3 | 56.5 | 294 | phosphatidate cytidylyltransferase |
| 2217 | 5717 | 2137840 | 2137286 | 555 | sp: RRF_BACSU | *Bacillus subtilis* 168 frr | 47.0 | 84.3 | 185 | ribosome recycling factor |
| 2218 | 5718 | 2138664 | 2137936 | 729 | prf: 2510355C | *Pseudomonas aeruginosa* pyrH | 28.4 | 43.1 | 109 | uridylate kinase |
| 2219 | 5719 | 2138994 | 2139854 | 861 | | | | | | |
| 2220 | 5720 | 2139827 | 2139003 | 825 | sp: EFTS_STRCO | *Streptomyces coelicolor* A3(2) SC2E1.42 tsf | 49.6 | 76.8 | 280 | elongation factor Ts |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2221 | 5721 | 2140886 | 2140071 | 816 | pir: A69699 | Bacillus subtilis rpsB | 54.7 | 83.5 | 254 | 30S ribosomal protein S2 |
| 2222 | 5722 | 2141257 | 2141760 | 504 | sp: YS91_MYCTU | Mycobacterium tuberculosis H37Rv Rv2891 | 46.0 | 58.0 | 120 | hypothetical protein |
| 2223 | 5723 | 2142686 | 2141763 | 924 | prf: 2417318A | Proteus mirabilis xerD | 40.1 | 68.7 | 297 | site-specific recombinase |
| 2224 | 5724 | 2144066 | 2142885 | 1182 | sp: YX27_MYCTU | Mycobacterium tuberculosis H37Rv Rv2896c | 39.8 | 66.8 | 395 | hypothetical protein |
| 2225 | 5725 | 2145586 | 2144066 | 1521 | sp: YX28_MYCTU | Mycobacterium tuberculosis H37Rv Rv2897c | 46.6 | 75.8 | 504 | Mg(2+) chelatase family protein |
| 2226 | 5726 | 2145941 | 2145576 | 366 | sp: YX29_MYCTU | Mycobacterium tuberculosis H37Rv Rv2898c | 40.3 | 72.3 | 119 | hypothetical protein |
| 2227 | 5727 | 2146566 | 2146264 | 303 | sp: YT01_MYCTU | Mycobacterium tuberculosis H37Rv Rv2901c | 68.3 | 96.0 | 101 | hypothetical protein |
| 2228 | 5728 | 2147192 | 2146566 | 627 | sp: RNH2_HAEN | Haemophilus influenzae Rd HI1059 rnhB | 42.6 | 69.5 | 190 | ribonuclease HII |
| 2229 | 5729 | 2147231 | 2148022 | 792 | | | | | | |
| 2230 | 5730 | 2148046 | 2147261 | 786 | prf: 2514288H | Streptomyces lividans TK21 sipY | 32.3 | 61.1 | 285 | signal peptidase |
| 2231 | 5731 | 2148231 | 2149166 | 936 | prf: 2510361A | Staphylococcus aureus sirA | 25.4 | 59.1 | 323 | Fe-regulated protein |
| 2232 | 5732 | 2149571 | 2149359 | 213 | | | | | | |
| 2233 | 5733 | 2149972 | 2149634 | 339 | sp: RL19_BACST | Bacillus stearothermophilus rplS | 70.3 | 88.3 | 111 | 50S ribosomal protein L19 |
| 2234 | 5734 | 2150335 | 2150997 | 663 | sp: THIE_BACSU | Bacillus subtilis 168 thiE | 28.4 | 60.9 | 225 | thiamine phosphate pyrophosphorylase |
| 2235 | 5735 | 2151039 | 2152118 | 1080 | gp: SC6E10_1 | Streptomyces coelicolor A3(2) SC6E10.01 | 34.0 | 64.1 | 376 | oxidoreductase |
| 2236 | 5736 | 2152135 | 2152329 | 195 | sp: THIS_ECOLI | Escherichia coli K12 thiS | 37.1 | 74.2 | 62 | thiamine biosynthetic enzyme thiS (thiG1) protein |
| 2237 | 5737 | 2152334 | 2153113 | 780 | sp: THIG_ECOLI | Escherichia coli K12 thiG | 48.2 | 76.9 | 251 | thiamine biosynthetic enzyme thiG protein |
| 2238 | 5738 | 2153058 | 2154191 | 1134 | prf: 2417383A | Emericella nidulans cnxF | 30.2 | 56.8 | 437 | molybdopterin biosynthesis protein |
| 2239 | 5739 | 2156733 | 2154460 | 2274 | sp: TEX_BORPE | Bordetella pertussis TOHAMA I tex | 56.6 | 78.7 | 776 | transcriptional accessory protein |
| 2240 | 5740 | 2157721 | 2156747 | 975 | pir: A36940 | Bacillus subtilis 168 degA | 27.0 | 65.3 | 334 | sporulation-specific degradation regulator protein |
| 2241 | 5741 | 2159181 | 2157754 | 1428 | pir: H72105 | Chlamydophila pneumoniae CWL029 ybhI | 45.8 | 78.3 | 456 | dicarboxylase translocator |
| 2242 | 5742 | 2159237 | 2159019 | 219 | prf: 2108268A | Spinacia oleracea chloroplast | 40.0 | 80.0 | 65 | 2-oxoglutarate/malate translocator |
| 2243 | 5743 | 2160537 | 2159287 | 1251 | sp: PCAB_PSEPU | Pseudomonas putida pcaB | 39.1 | 66.3 | 350 | 3-carboxy-cis, cis-muconate cycloisomerase |
| 2244 | 5744 | 2160670 | 2160768 | 99 | | | | | | |
| 2245 | 5745 | 2161503 | 2161111 | 393 | | | | | | |
| 2246 | 5746 | 2162196 | 2161507 | 690 | | | | | | |
| 2247 | 5747 | 2163014 | 2162196 | 819 | sp: TRMD_ECOLI | Escherichia coli K12 trmD | 34.8 | 64.8 | 273 | tRNA (guanine-N1)-methyltransferase |
| 2248 | 5748 | 2163098 | 2163745 | 648 | gp: SCF81_27 | Streptomyces coelicolor A3(2) SCF81.27 | 30.5 | 57.6 | 210 | hypothetical protein |
| 2249 | 5749 | 2164260 | 2163748 | 513 | sp: RIMM_MYCLE | Mycobacterium leprae MLCB250.34. rimM | 52.3 | 72.1 | 172 | 16S rRNA processing protein |
| 2250 | 5750 | 2164390 | 2164737 | 348 | pir: B71881 | Helicobacter pylori J99 jhp0839 | 29.0 | 66.7 | 69 | hypothetical protein |
| 2251 | 5751 | 2165309 | 2164815 | 495 | pir: C47154 | Bacillus subtilis 168 rpsP | 47.0 | 79.5 | 83 | 30S ribosomal protein S16 |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2252 | 5752 | 2165523 | 2166098 | 576 | pir: T14151 | Mus musculus inv | 32.1 | 61.7 | 196 | inversin |
| 2253 | 5753 | 2166990 | 2166124 | 867 | prf: 2512328G | Streptococcus agalactiae cylB | 26.6 | 69.1 | 256 | ABC transporter |
| 2254 | 5754 | 2167865 | 2166990 | 876 | prf: 2220349C | Pyrococcus horikoshii OT3 mtrA | 35.5 | 63.8 | 318 | ABC transporter |
| 2255 | 5755 | 2169584 | 2167944 | 1641 | sp: SR54_BACSU | Bacillus subtilis 168 ffh | 58.7 | 78.2 | 559 | signal recognition particle protein |
| 2256 | 5756 | 2170426 | 2171058 | 633 | | | | | | |
| 2257 | 5757 | 2171715 | 2172131 | 417 | | | | | | |
| 2258 | 5758 | 2172209 | 2172877 | 669 | | | | | | |
| 2259 | 5759 | 2175288 | 2173759 | 1530 | sp: FTSY_ECOLI | Escherichia coli K12 ftsY | 37.0 | 66.1 | 505 | cell division protein |
| 2260 | 5760 | 2176046 | 2175888 | 159 | | | | | | |
| 2261 | 5761 | 2176402 | 2177103 | 702 | | | | | | |
| 2262 | 5762 | 2179502 | 2176110 | 3393 | sp: AMYH_YEAST | Saccharomyces cerevisiae S288C YIR019C sta1 | 22.4 | 46.2 | 1144 | glucan 1,4-alpha-glucosidase or glucoamylase S1/S2 precursor |
| 2263 | 5763 | 2180918 | 2181880 | 963 | sp: Y06B_MYCTU | Mycobacterium tuberculosis H37Rv Rv2922c | 48.3 | 72.6 | 1206 | chromosome segregation protein |
| 2264 | 5764 | 2183092 | 2179628 | 3465 | sp: Y06F_MYCTU | Mycobacterium tuberculosis H37Rv Rv2922c | | | | |
| 2265 | 5765 | 2183391 | 2183110 | 282 | sp: ACYP_MYCTU | Mycobacterium tuberculosis H37Rv Rv2922.1C | 51.1 | 73.9 | 92 | acylphosphatase |
| 2266 | 5766 | 2185258 | 2183405 | 1854 | sp: YFER_ECOLI | Escherichia coli K12 yfeR | 23.9 | 60.0 | 305 | transcriptional regulator |
| 2267 | 5767 | 2186208 | 2185351 | 858 | pir: S72748 | Mycobacterium leprae MLCL581.28c | 39.3 | 73.5 | 257 | hypothetical membrane protein |
| 2268 | 5768 | 2186299 | 2187129 | 831 | | | | | | |
| 2269 | 5769 | 2187160 | 2187342 | 183 | | | | | | |
| 2270 | 5770 | 2187679 | 2187233 | 447 | | | | | | |
| 2271 | 5771 | 2188306 | 2187692 | 615 | gp: DNINTREG_3 | Dichelobacter nodosus gep | 46.8 | 76.6 | 188 | cation efflux system protein |
| 2272 | 5772 | 2189170 | 2188313 | 858 | sp: FPG_ECOLI | Escherichia coli K12 mutM or fpg | 36.1 | 66.7 | 285 | formamidopyrimidine-DNA glycosylase |
| 2273 | 5773 | 2189906 | 2189166 | 741 | pir: B69693 | Bacillus subtilis 168 rncS | 40.3 | 76.5 | 221 | ribonuclease III |
| 2274 | 5774 | 2190439 | 2189906 | 534 | sp: Y06F_MYCTU | Mycobacterium tuberculosis H37Rv Rv2926c | 35.8 | 62.5 | 176 | hypothetical protein |
| 2275 | 5775 | 2191328 | 2190540 | 789 | sp: Y06G_MYCTU | Mycobacterium tuberculosis H37Rv Rv2927c | 50.0 | 76.9 | 238 | hypothetical protein |
| 2276 | 5776 | 2191522 | 2193165 | 1644 | prf: 2104260G | Streptomyces verticillus | 28.3 | 55.6 | 559 | transport protein |
| 2277 | 5777 | 2193165 | 2194694 | 1530 | sp: CYDC_ECOLI | Escherichia coli K12 cydC | 26.6 | 58.8 | 541 | ABC transporter |
| 2278 | 5778 | 2196883 | 2198004 | 1122 | gp: SC9C7_2 | Streptomyces coelicolor A3(2) SC9C7.02 | 35.3 | 62.6 | 388 | hypothetical protein |
| 2279 | 5779 | 2198447 | 2198007 | 441 | | | | | | |
| 2280 | 5780 | 2198475 | 2199758 | 1284 | pir: A72322 | Thermotoga maritima MSB8 TM0896 | 21.0 | 43.7 | 405 | hypothetical protein |
| 2281 | 5781 | 2199808 | 2201070 | 1263 | sp: HIPO_CAMJE | Campylobacter jejuni ATCC 43431 hipO | 32.9 | 64.3 | 353 | peptidase |
| 2282 | 5782 | 2201408 | 2201073 | 336 | pir: S38197 | Arabidopsis thaliana SUC1 | 27.1 | 51.9 | 133 | sucrose transport protein |
| 2283 | 5783 | 2201584 | 2201450 | 135 | | | | | | |
| 2284 | 5784 | 2201869 | 2201594 | 276 | | | | | | |
| 2285 | 5785 | 2204541 | 2201992 | 2550 | prf: 2513410A | Thermococcus litoralis malP | 36.1 | 67.4 | 814 | maltodextrin phosphorylase/glycogen phosphorylase |
| 2286 | 5786 | 2205490 | 2204591 | 900 | sp: YFIE_BACSU | Bacillus subtilis 168 yfiE | 33.9 | 66.4 | 295 | hypothetical protein |
| 2287 | 5787 | 2208249 | 2207302 | 948 | sp: LGT_STAAU | Staphylococcus aureus FDA 485 lgt | 31.4 | 65.5 | 264 | prolipoprotein diacylglyceryl transferase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2288 | 5788 | 2209167 | 2208367 | 801 | sp: TRPG_EMENI | Emericella nidulans trpC | 29.6 | 62.1 | 169 | indole-3-glycerol-phosphate synthase/anthranilate synthase component II |
| 2289 | 5789 | 2209888 | 2209232 | 657 | pir: H70556 | Mycobacterium tuberculosis H37Rv Rv1610 | 29.4 | 58.8 | 228 | hypothetical membrane protein |
| 2290 | 5790 | 2210273 | 2209920 | 354 | sp: HIS3_RHOSH | Rhodobacter sphaeroides ATCC 17023 hisI | 52.8 | 79.8 | 89 | phosphoribosyl-AMP cyclohydrolase |
| 2291 | 5791 | 2211046 | 2210273 | 774 | sp: HIS6_CORG | Corynebacterium glutamicum AS019 hisF | 97.3 | 97.7 | 258 | cyclase |
| 2292 | 5792 | 2211875 | 2211051 | 825 | prf: 2419176B | Corynebacterium glutamicum AS019 impA | 94.0 | 94.0 | 241 | inositol monophosphate phosphatase |
| 2293 | 5793 | 2212619 | 2211882 | 738 | gp: AF051846_1 | Corynebacterium glutamicum AS019 hisA | 95.9 | 97.6 | 245 | phosphoribosylformimino-5-aminoimidazole carboxamide ribotide isomerase |
| 2294 | 5794 | 2213273 | 2212641 | 633 | gp: AF060558_1 | Corynebacterium glutamicum AS019 hisH | 86.7 | 92.4 | 210 | glutamine amidotransferase |
| 2295 | 5795 | 2215586 | 2214321 | 1266 | sp: CMLR_STRLI | Streptomyces lividans 66 cmlR | 25.6 | 54.0 | 402 | chloramphenicol resistance protein or transmembrane transport protein |
| 2296 | 5796 | 2215863 | 2215639 | 225 | sp: HIS7_STRCO | Streptomyces coelicolor A3(2) hisB | 52.5 | 81.8 | 198 | imidazoleglycerol-phosphate dehydratase |
| 2297 | 5797 | 2216474 | 2215869 | 606 | | | | | | |
| 2298 | 5798 | 2217591 | 2216494 | 1098 | sp: HIS8_STRCO | Streptomyces coelicolor A3(2) hisC | 57.2 | 79.3 | 362 | histidinol-phosphate aminotransferase |
| 2299 | 5799 | 2218925 | 2217600 | 1326 | sp: HISX_MYCSM | Mycobacterium smegmatis ATCC 607 hisD | 63.8 | 85.7 | 439 | histidinol dehydrogenase |
| 2300 | 5800 | 2219159 | 2220358 | 1200 | gp: SPBC215_13 | Schizosaccharomyces pombe SPBC215.13 | 27.2 | 54.4 | 342 | serine-rich secreted protein |
| 2301 | 5801 | 2221109 | 2220459 | 651 | | | | | | |
| 2302 | 5802 | 2221611 | 2221919 | 309 | | | | | | |
| 2303 | 5803 | 2221828 | 2221187 | 642 | prf: 2321269A | Leishmania donovani SAcP-1 | 29.4 | 59.7 | 211 | histidine secretory acid phosphatase |
| 2304 | 5804 | 2221958 | 2222518 | 561 | pir: RPECR1 | Escherichia coli plasmid RP1 tetR | 28.9 | 60.8 | 204 | tet repressor protein |
| 2305 | 5805 | 2222528 | 2225035 | 2508 | prf: 2307203B | Sulfolobus acidocaldarius treX | 47.4 | 75.5 | 722 | glycogen debranching enzyme |
| 2306 | 5806 | 2225149 | 2225949 | 801 | pir: E70572 | Mycobacterium tuberculosis H37Rv Rv2622 | 50.0 | 76.0 | 258 | hypothetical protein |
| 2307 | 5807 | 2226763 | 2225990 | 774 | gp: SC2G5_27 | Streptomyces coelicolor A3(2) SC2G5.27c gip | 29.9 | 55.2 | 268 | oxidoreductase |
| 2308 | 5808 | 2227779 | 2226769 | 1011 | prf: 2503399A | SinoRhizobium meliloti ldhA | 35.0 | 60.9 | 343 | myo-inositol 2-dehydrogenase |
| 2309 | 5809 | 2227906 | 2228901 | 996 | sp: GALR_ECOLI | Escherichia coli K12 galR | 30.4 | 64.4 | 329 | galactitol utilization operon repressor |
| 2310 | 5810 | 2229896 | 2229099 | 798 | sp: FHUC_BACSU | Bacillus subtilis 168 fhuC | 32.9 | 68.3 | 246 | ferrichrome transport ATP-binding protein or ferrichrome ABC transporter |
| 2311 | 5811 | 2230937 | 2229900 | 1038 | prf: 2423441E | Vibrio cholerae hutC | 36.8 | 71.1 | 332 | hemin permease |
| 2312 | 5812 | 2231294 | 2230947 | 348 | pir: G70046 | Bacillus subtilis 168 yvrC | 30.1 | 68.0 | 103 | iron-binding protein |
| 2313 | 5813 | 2231932 | 2231339 | 594 | pir: G70046 | Bacillus subtilis 168 yvrC | 34.6 | 67.6 | 182 | iron-binding protein |
| 2314 | 5814 | 2232456 | 2232016 | 441 | sp: YTFH_ECOLI | Escherichia coli K12 ytfH | 38.1 | 73.5 | 113 | hypothetical protein |
| 2315 | 5815 | 2232928 | 2234070 | 1143 | gp: SCI8_12 | Streptomyces coelicolor A3(2) SCI8.12 | 23.4 | 50.1 | 355 | DNA polymerase III epsilon chain |
| 2316 | 5816 | 2234158 | 2234763 | 606 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2317 | 5817 | 2234852 | 2237284 | 2433 | pir: S65769 | Arthrobacter sp. Q36 treY | 42.0 | 68.6 | 814 | maltooligosyl trehalose synthase |
| 2318 | 5818 | 2237331 | 2238353 | 1023 | gp: AE002006_4 | Deinococcus radiodurans DR1631 | 27.6 | 52.8 | 322 | hypothetical protein |
| 2319 | 5819 | 2239092 | 2238694 | 399 | | | | | | |
| 2320 | 5820 | 2240042 | 2239845 | 198 | | | | | | |
| 2321 | 5821 | 2240246 | 2240058 | 189 | | | | | | |
| 2322 | 5822 | 2240563 | 2239508 | 1056 | | | | | | |
| 2323 | 5823 | 2240681 | 2241724 | 1044 | sp: LXA1_PHOLU | Photorhabdus luminescens ATCC 29999 luxA | 20.5 | 54.4 | 375 | alkanal monooxygenase alpha chain |
| 2324 | 5824 | 2242115 | 2241738 | 378 | gp: SC7H2_5 | Streptomyces coelicolor A3(2) SC7H2.05 | 58.3 | 79.2 | 120 | hypothetical protein |
| 2325 | 5825 | 2242359 | 2242129 | 231 | | | | | | maltooligosyltrehalose trehalohydrolase |
| 2326 | 5826 | 2243035 | 2244819 | 1785 | | Arthrobacter sp. Q36 treZ | 46.3 | 72.4 | 568 | |
| 2327 | 5827 | 2243043 | 2242393 | 651 | sp: YVYE_BACSU | Bacillus subtilis 168 | 36.5 | 72.4 | 214 | hypothetical protein |
| 2328 | 5828 | 2246171 | 2244864 | 1308 | sp: THD1_CORGL | Corynebacterium glutamicum ATCC 13032 ilvA | 99.3 | 99.3 | 436 | threonine dehydratase |
| 2329 | 5829 | 2246386 | 2246892 | 507 | | | | | | |
| 2330 | 5830 | 2246450 | 2246295 | 156 | | | | | | |
| 2331 | 5831 | 2248208 | 2247006 | 1203 | pir: S57636 | Catharanthus roseus metE | 22.7 | 49.6 | 415 | Corynebacterium glutamicum AS019 |
| 2332 | 5832 | 2251939 | 2248358 | 3582 | prf: 2508371A | Streptomyces coelicolor A3(2) dnaE | 53.3 | 80.5 | 1183 | DNA polymerase III |
| 2333 | 5833 | 2252017 | 2252856 | 840 | sp: RARD_ECOLI | Escherichia coli K12 rarD | 37.6 | 73.8 | 279 | chloramphenicol sensitive protein |
| 2334 | 5834 | 2253192 | 2253659 | 468 | sp: HISJ_CAMJE | Campylobacter jejuni DZ72 hisJ | 21.5 | 55.7 | 149 | histidine-binding protein precursor |
| 2335 | 5835 | 2253725 | 2254642 | 918 | pir: D69548 | Archaeoglobus fulgidus AF2388 | 22.7 | 64.7 | 198 | hypothetical membrane protein |
| 2336 | 5836 | 2255558 | 2254683 | 876 | sp: GS39_BACSU | Bacillus subtilis 168 ydaD | 48.2 | 80.0 | 280 | short chain dehydrogenase or general stress protein |
| 2337 | 5837 | 2257024 | 2255738 | 1287 | sp: DCDA_PSEAE | Pseudomonas aeruginosa lysA | 22.9 | 47.6 | 445 | diaminopimelate (DAP) decarboxylase |
| 2338 | 5838 | 2259312 | 2258362 | 951 | sp: CYSM_ALCEU | Alcaligenes eutrophus CH34 cysM | 32.8 | 64.3 | 314 | cysteine synthase |
| 2339 | 5839 | 2259999 | 2259421 | 579 | | | | | | ribosomal large subunit pseudouridine synthase D |
| 2340 | 5840 | 2260931 | 2260002 | 930 | sp: RLUD_ECOLI | Escherichia coli K12 rluD | 36.5 | 61.0 | 326 | |
| 2341 | 5841 | 2261467 | 2260934 | 534 | sp: LSPA_PSEFL | Pseudomonas fluorescens NCIB 10586 lspA | 33.8 | 61.7 | 154 | lipoprotein signal peptidase |
| 2342 | 5842 | 2261688 | 2262689 | 1002 | | | | | | |
| 2343 | 5843 | 2262850 | 2264499 | 1650 | pir: S67863 | Streptomyces antibioticus oleB | 36.4 | 64.0 | 550 | oleandomycin resistance protein |
| 2344 | 5844 | 2264996 | 2265298 | 303 | | | | | | |
| 2345 | 5845 | 2265108 | 2264509 | 600 | prf: 2422382P | Rhodococcus erythropolis orf17 | 36.7 | 57.6 | 158 | hypothetical protein |
| 2346 | 5846 | 2265420 | 2266394 | 975 | sp: ASPG_BACLI | Bacillus licheniformis | 31.2 | 62.0 | 321 | L-asparaginase |
| 2347 | 5847 | 2268297 | 2266897 | 1401 | sp: DINP_ECOLI | Escherichia coli K12 dinP | 31.8 | 60.7 | 371 | DNA-damage-inducible protein P |
| 2348 | 5848 | 2269245 | 2268388 | 858 | sp: YBIF_ECOLI | Escherichia coli K12 ybiF | 31.5 | 61.5 | 286 | hypothetical membrane protein |
| 2349 | 5849 | 2270261 | 2269260 | 1002 | gp: SCF51_6 | Streptomyces coelicolor A3(2) SCF51.06 | 44.3 | 73.1 | 334 | transcriptional regulator |
| 2350 | 5850 | 2270304 | 2270435 | 132 | | | | | | |
| 2351 | 5851 | 2270884 | 2270258 | 627 | gp: SCF51_5 | Streptomyces coelicolor A3(2) SCF51.05 | 42.0 | 67.0 | 212 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2352 | 5852 | 2274149 | 2270988 | 3162 | sp: SYIC_YEAST | *Saccharomyces cerevisiae* A364A YBL076C ILS1 | 38.5 | 65.4 | 1066 | isoleucyl-tRNA synthetase |
| 2353 | 5853 | 2274688 | 2274473 | 216 | | | | | | |
| 2354 | 5854 | 2275861 | 2274767 | 1095 | | | | | | |
| 2355 | 5855 | 2276637 | 2276353 | 285 | pir: F70578 | *Mycobacterium tuberculosis* H37Rv Rv2146c | 46.3 | 73.2 | 82 | hypothetical membrane protein |
| 2356 | 5856 | 2277336 | 2276881 | 456 | gp: BLFTSZ_6 | *Brevibacterium lactofermentum* orf6 | 99.3 | 99.3 | 152 | hypothetical protein (putative YAK 1 protein) |
| 2357 | 5857 | 2278078 | 2277416 | 663 | sp: YFZ1_CORGL | *Corynebacterium glutamicum* | 97.7 | 99.6 | 221 | hypothetical protein |
| 2358 | 5858 | 2278859 | 2278122 | 738 | prf: 2420425C | *Brevibacterium lactofermentum* yflh | 99.2 | 100.0 | 246 | hypothetical protein |
| 2359 | 5859 | 2279155 | 2279640 | 486 | GP: AB028868_1 | *Mus musculus* P4(21)n | 39.0 | 51.0 | 117 | hypothetical protein |
| 2360 | 5860 | 2280215 | 2278890 | 1326 | sp: FTSZ_BRELA | *Brevibacterium lactofermentum* ftsZ | 98.6 | 98.6 | 442 | cell division protein |
| 2361 | 5861 | 2281135 | 2280470 | 666 | gsp: W70502 | *Corynebacterium glutamicum* ftsQ | 99.6 | 100.0 | 222 | cell division initiation protein or cell division protein |
| 2362 | 5862 | 2282623 | 2281166 | 1458 | gp: AB015023_1 | *Corynebacterium glutamicum* murC | 99.4 | 99.8 | 486 | UDP-N-acetylmuramate—alanine ligase |
| 2363 | 5863 | 2283776 | 2282661 | 1116 | gp: BLA242646_3 | *Brevibacterium lactofermentum* ATCC 13869 murG | 98.9 | 99.5 | 372 | UDP-N-acetylglucosamine-N-acetylmuramyl-(pentapeptide) pyrophosphoryl-undecaprenol N-acetylglucosamine pyrophosphoryl-undecaprenol N-acetylglucosamine |
| 2364 | 5864 | 2285431 | 2283782 | 1650 | gp: BLA242646_3 | *Brevibacterium lactofermentum* ATCC 13869 ftsW | 99.4 | 99.6 | 490 | cell division protein |
| 2365 | 5865 | 2285904 | 2285437 | 468 | gp: BLA242646_1 | *Brevibacterium lactofermentum* ATCC 13869 murD | 99.1 | 99.1 | 110 | UDP-N-acetylmuramoylalanine-D-glutamate ligase |
| 2366 | 5866 | 2286272 | 2286655 | 384 | | | | | | |
| 2367 | 5867 | 2286499 | 2286831 | 333 | | | | | | |
| 2368 | 5868 | 2287959 | 2286862 | 1098 | sp: MRAY_ECOLI | *Escherichia coli* K12 mraY | 38.6 | 63.8 | 365 | phospho-n-acetylmuramoyl-pentapeptide |
| 2369 | 5869 | 2289510 | 2287969 | 1542 | sp: MURF_ECOLI | *Escherichia coli* K12 murF | 35.0 | 64.2 | 494 | UDP-N-acetylmuramoylalanyl-D-glutamyl-2,6-diaminopImelate-D-alanyl-D-alanyl ligase |
| 2370 | 5870 | 2291073 | 2289523 | 1551 | sp: MURE_BACSU | *Bacillus subtilis* 168 murE | 37.7 | 67.6 | 491 | UDP-N-acetylmuramoylalanyl-D-glutamyl-2,6-diaminopimelate-D-alanyl-D-alanyl ligase |
| 2371 | 5871 | 2291197 | 2290973 | 225 | GSP: Y33117 | *Brevibacterium lactofermentum* ORF2 pbp | 100.0 | 100.0 | 57 | penicillin binding protein |
| 2372 | 5872 | 2293164 | 2291212 | 1953 | pir: S54872 | *Pseudomonas aeruginosa* pbpB | 28.2 | 58.8 | 650 | penicillin-binding protein |
| 2373 | 5873 | 2294117 | 2293323 | 795 | | | | | | |
| 2374 | 5874 | 2295127 | 2294117 | 1011 | pir: A70581 | *Mycobacterium tuberculosis* H37Rv Rv2165c | 55.1 | 79.3 | 323 | hypothetical protein |
| 2375 | 5875 | 2295804 | 2295376 | 429 | gp: MLCB268_11 | *Mycobacterium leprae* MLCB268.11c | 72.0 | 88.8 | 143 | hypothetical membrane protein |
| 2376 | 5876 | 2296898 | 2296512 | 387 | pir: C70935 | *Mycobacterium tuberculosis* H37Rv Rv2169c | 39.4 | 69.3 | 137 | hypothetical protein |
| 2377 | 5877 | 2297653 | 2297231 | 423 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2378 | 5878 | 2297866 | 2298438 | 573 | gp: MLCB268_13 | *Mycobacterium leprae* MLCB268.13 | 36.3 | 65.3 | 190 | hypothetical protein |
| 2379 | 5879 | 2299428 | 2298451 | 978 | sp: METF_STRLI | *Streptomyces lividans* 1326 metF | 42.6 | 70.6 | 303 | 5,10-methylenetetrahydrofolate reductase |
| 2380 | 5880 | 2299524 | 2300636 | 1113 | pir: S32168 | *Myxococcus xanthus* DK1050 ORF1 | 30.1 | 62.0 | 329 | dimethylallyltranstransferase |
| 2381 | 5881 | 2300706 | 2302175 | 1470 | gp: MLCB268_16 | *Mycobacterium leprae* MLCB268.17 | 35.7 | 69.6 | 484 | hypothetical membrane protein |
| 2382 2383 | 5882 5883 | 2302179 2302619 | 2302685 2302251 | 507 369 | pir: A70936 | *Mycobacterium tuberculosis* H37Rv Rv2175c | 43.2 | 68.8 | 125 | hypothetical protein |
| 2384 | 5884 | 2302833 | 2304980 | 2148 | gp: AB019394_1 | *Streptomyces coelicolor* A3(2) pkaF | 34.2 | 62.4 | 684 | eukaryotic-type protein kinase |
| 2385 2386 | 5885 5886 | 2303690 2304983 | 2303040 2306218 | 651 1236 | gp: MLCB268_21 | *Mycobacterium leprae* MLCB268.23 | 30.7 | 58.4 | 411 | hypothetical membrane protein |
| 2387 | 5887 | 2306314 | 2307621 | 1308 | pir: G70936 | *Mycobacterium tuberculosis* H37Rv Rv2181 | 30.4 | 62.0 | 434 | hypothetical membrane protein |
| 2388 | 5888 | 2309082 | 2307697 | 1386 | gp: AF260581_2 | *Amycolatopsis mediterranei* | 66.9 | 87.9 | 462 | 3-deoxy-D-arabino-heptulosonate-7-phosphate synthase |
| 2389 | 5889 | 2309676 | 2309173 | 504 | gp: MLCB268_20 | *Mycobacterium leprae* MLCB268.21c | 58.4 | 77.7 | 166 | hypothetical protein |
| 2390 | 5890 | 2309835 | 2312252 | 2418 | pir: G70936 | *Mycobacterium tuberculosis* H37Rv Rv2181 | 35.1 | 64.5 | 428 | hypothetical membrane protein |
| 2391 | 5891 | 2312360 | 2313808 | 1449 | sp: CSP1_CORGL | *Corynebacterium glutamicum* (*Brevibacterium flavum*) ATCC 17965 csp1 | 28.2 | 57.1 | 440 | major secreted protein PS1 protein precursor |
| 2392 2393 2394 | 5892 5893 5894 | 2313833 2314092 2315423 | 2314036 2313916 2314236 | 204 177 1188 | gp: AF096280_3 | *Corynebacterium glutamicum* ATCC 13032 | 100.0 | 100.0 | 249 | hypothetical membrane protein |
| 2395 | 5895 | 2316412 | 2315678 | 735 | gp: AF096280_2 | *Corynebacterium glutamicum* ATCC 13032 | 100.0 | 100.0 | 245 | acyltransferase |
| 2396 | 5896 | 2318775 | 2317633 | 1143 | gp: SC6G10_5 | *Streptomyces coelicolor* A3(2) SC6G10.05c | 50.1 | 75.7 | 383 | glycosyl transferase |
| 2397 | 5897 | 2319850 | 2318804 | 1047 | sp: P60_LISIV | *Listeria ivanovii* iap | 26.4 | 60.8 | 296 | protein P60 precursor (invasion-associated-protein) |
| 2398 | 5898 | 2320594 | 2319968 | 627 | sp: P60_LISGR | *Listeria grayi* iap | 33.0 | 61.3 | 191 | protein P60 precursor (invasion-associated-protein) |
| 2399 | 5899 | 2323073 | 2321472 | 1602 | prf: 2504621K | *Heliobacillus mobilis* petB | 34.3 | 64.7 | 201 | ubiquinol-cytochrome c reductase cytochrome b subunit |
| 2400 | 5900 | 2323759 | 2323088 | 672 | gp: AF107888_1 | *Streptomyces lividans* qcrA | 37.9 | 57.1 | 203 | ubiquinol-cytochrome c reductase iron-sulfur subunit (Rieske [eFe-2S] iron-sulfur protein cyoB |
| 2401 | 5901 | 2325195 | 2324311 | 885 | sp: Y005_MYCTU | *Mycobacterium tuberculosis* H37Rv Rv2194 qcrC | 58.6 | 83.1 | 278 | ubiquinol-cytochrome c reductase cytochrome c |
| 2402 2403 | 5902 5903 | 2325887 2326273 | 2325273 2326121 | 615 153 | sp: COX3_SYNVU | *Synechococcus vulcanus* | 36.7 | 70.7 | 188 | cytochrome c oxidase subunit III |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2404 | 5904 | 2326900 | 2326472 | 429 | sp: Y00A_MYCTU | *Mycobacterium tuberculosis* H37Rv Rv2199c | 38.6 | 71.0 | 145 | hypothetical membrane protein |
| 2405 | 5905 | 2327997 | 2326921 | 1077 | sp: COX2_RHOSH | *Rhodobacter sphaeroides* ctaC | 28.7 | 53.9 | 317 | cytochrome c oxidase subunit II |
| 2406 | 5906 | 2328516 | 2330435 | 1920 | gp: AB029550_1 | *Corynebacterium glutamicum* KY9611 ltsA | 99.7 | 99.8 | 640 | glutamine-dependent amidotransferase or asparagine synthetase (lysozyme insensitivity protein) |
| 2407 | 5907 | 2330927 | 2330586 | 342 | gp: AB029550_2 | *Corynebacterium glutamicum* KY9611 orf1 | 100.0 | 100.0 | 114 | hypothetical protein |
| 2408 | 5908 | 2331200 | 2331967 | 768 | gp: MLCB22_2 | *Mycobacterium leprae* MLCB22.07 | 35.0 | 60.2 | 246 | hypothetical membrane protein |
| 2409 | 5909 | 2331974 | 2332495 | 522 | pir: S52220 | *Rhodobacter capsulatus* cobP | 43.0 | 64.0 | 172 | cobinamide kinase |
| 2410 | 5910 | 2332512 | 2333600 | 1089 | sp: COBU_PSEDE | *Pseudomonas denitrificans* cobU | 37.8 | 66.9 | 341 | nicotinate-nucleotide—dimethylbenzimidazole phosphoribosyltransferase |
| 2411 | 5911 | 2333615 | 2334535 | 921 | sp: COBV_PSEDE | *Pseudomonas denitrificans* cobV | 25.3 | 49.8 | 305 | cobalamin (5′-phosphate) synthase |
| 2412 | 5912 | 2334717 | 2334481 | 237 | | | | | | |
| 2413 | 5913 | 2335741 | 2335028 | 714 | prf: 2414335A | *Streptomyces clavuligerus* car | 38.6 | 68.5 | 241 | clavulanate-9-aldehyde reductase |
| 2414 | 5914 | 2337051 | 2335915 | 1137 | sp: ILVE_MYCTU | *Mus musculus* BCAT1 | 40.1 | 70.3 | 364 | branched-chain amino acid aminotransferase |
| 2415 | 5915 | 2337235 | 2338734 | 1500 | gp: PPU010261_1 | *Pseudomonas putida* ATCC 12633 pepA | 36.3 | 65.9 | 493 | leucyl aminopeptidase |
| 2416 | 5916 | 2339140 | 2338748 | 393 | prf: 2110282A | *Saccharopolyspora erythraea* ORF1 | 40.2 | 67.0 | 97 | hypothetical protein |
| 2417 | 5917 | 2339269 | 2341293 | 2025 | gp: AF047034_2 | *Streptomyces seoulensis* pdhB | 48.9 | 68.5 | 691 | dihydrolipoamide acetyltransferase |
| 2418 | 5918 | 2340804 | 2339440 | 1365 | | | | | | |
| 2419 | 5919 | 2341412 | 2342164 | 753 | gp: AB020975_1 | *Arabidopsis thaliana* | 36.7 | 65.7 | 210 | lipoyltransferase |
| 2420 | 5920 | 2342304 | 2343347 | 1044 | sp: LIPA_PELCA | *Pelobacter carbinolicus* GRA BD1 lipA | 44.6 | 70.9 | 285 | lipoic acid synthetase |
| 2421 | 5921 | 2343479 | 2344258 | 780 | sp: Y00U_MYCTU | *Mycobacterium tuberculosis* H37Rv Rv2219 | 45.5 | 76.7 | 257 | hypothetical membrane protein |
| 2422 | 5922 | 2344431 | 2346047 | 1617 | sp: YIDE_ECOLI | *Escherichia coli* K12 yidE | 32.9 | 67.8 | 559 | hypothetical membrane protein |
| 2423 | 5923 | 2347491 | 2346289 | 1203 | gp: AF189147_1 | *Corynebacterium glutamicum* ATCC 13032 tnp | 100.0 | 100.0 | 401 | transposase (ISCg2) |
| 2424 | 5924 | 2347505 | 2347804 | 300 | gp: SC5F7_34 | *Streptomyces coelicolor* A3(2) SC5F7.04c | 41.4 | 63.7 | 157 | hypothetical membrane protein |
| 2425 | 5925 | 2348548 | 2348078 | 471 | | | | | | |
| 2426 | 5926 | 2350620 | 2350408 | 213 | pir: B72308 | *Thermotoga maritima* MSB8 TM1010 | 31.0 | 44.0 | 145 | mutator mutT domain protein |
| 2427 | 5927 | 2351022 | 2351996 | 975 | | | | | | |
| 2428 | 5928 | 2351310 | 2350912 | 399 | | | 36.7 | 65.6 | 128 | hypothetical protein |
| 2429 | 5929 | 2351909 | 2351310 | 600 | sp: LUXA_VIBHA | *Vibrio harveyi* luxA | 25.0 | 60.9 | 220 | alkanal monooxygenase alpha chain (bacterial luciferase alpha chain) |
| 2430 | 5930 | 2351980 | 2352828 | 849 | | | | | | |
| 2431 | 5931 | 2352833 | 2353225 | 393 | pir: A72404 | *Thermotoga maritima* MSB8 TM0215 | 40.5 | 73.0 | 111 | protein synthesis inhibitor (translation initiation inhibitor) |
| 2432 | 5932 | 2355156 | 2355398 | 243 | prf: 2203345H | *Escherichia coli* hpaX | 21.9 | 53.4 | 433 | 4-hydroxyphenylacetate permease |
| 2433 | 5933 | 2355440 | 2355180 | 261 | | | | | | |
| 2434 | 5934 | 2355521 | 2356843 | 1323 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2435 | 5935 | 2356794 | 2357354 | 561 | gp: SCGD3_10 | *Streptomyces coelicolor* A3(2) SCGD3.10c | 42.4 | 72.8 | 158 | transmembrane transport protein |
| 2436 | 5936 | 2357264 | 2357707 | 444 | gp: SCGD3_10 | *Streptomyces coelicolor* A3(2) SCGD3.10c | 31.4 | 66.1 | 118 | transmembrane transport protein |
| 2437 | 5937 | 2357484 | 2357290 | 195 | | | | | | |
| 2438 | 5938 | 2357726 | 2358130 | 405 | | | | | | |
| 2439 | 5939 | 2358695 | 2358153 | 543 | | | | | | |
| 2440 | 5940 | 2359416 | 2358772 | 645 | sp: HMUO_CORDI | *Corynebacterium diphtheriae* C7 hmuO | 57.9 | 78.0 | 214 | heme oxygenase |
| 2441 | 5941 | 2362748 | 2359614 | 3135 | gp: SCY17736_4 | *Streptomyces coelicolor* A3(2) glnE | 43.4 | 67.0 | 809 | glutamate-ammonia-ligase adenylyltransferase |
| 2442 | 5942 | 2364155 | 2362818 | 1338 | sp: GLNA_THEMA | *Thermotoga maritima* MSB8 glnA | 43.5 | 73.0 | 441 | glutamine synthetase |
| 2443 | 5943 | 2364352 | 2365455 | 1104 | gp: SCE9_39 | *Streptomyces coelicolor* A3(2) SCE9.39c | 26.8 | 54.1 | 392 | hypothetical protein |
| 2444 | 5944 | 2365587 | 2367413 | 1827 | sp: Y017_MYCTU | *Mycobacterium tuberculosis* H37Rv Rv2226 | 33.4 | 58.2 | 601 | hypothetical protein |
| 2445 | 5945 | 2367652 | 2367473 | 180 | gp: SCC75A_11 | *Streptomyces coelicolor* A3(2) SCC75A.11c | 38.9 | 55.6 | 54 | hypothetical protein |
| 2446 | 5946 | 2367791 | 2369083 | 1293 | sp: GAL1_HUMAN | *Homo sapiens* galK1 | 24.9 | 53.7 | 374 | galactokinase |
| 2447 | 5947 | 2370381 | 2369116 | 1266 | gp: AF174645_1 | *Brucella abortus* vacB | 27.1 | 54.5 | 358 | virulence-associated protein |
| 2448 | 5948 | 2370423 | 2370908 | 486 | | | | | | |
| 2449 | 5949 | 2372557 | 2371412 | 1146 | sp: Y019_MYCTU | *Mycobacterium tuberculosis* H37Rv Rv2228c | 54.7 | 75.1 | 382 | bifunctional protein (ribonuclease H and phosphoglycerate mutase) |
| 2450 | 5950 | 2372561 | 2373289 | 729 | sp: Y01A_MYCTU | *Mycobacterium tuberculosis* H37Rv Rv2229c | 26.5 | 58.6 | 249 | hypothetical protein |
| 2451 | 5951 | 2373289 | 2372573 | 717 | | | | | | |
| 2452 | 5952 | 2374462 | 2373323 | 1140 | sp: Y01B_MYCTU | *Mycobacterium tuberculosis* H37Rv Rv2230c | 49.2 | 76.2 | 378 | hypothetical protein |
| 2453 | 5953 | 2374544 | 2375197 | 654 | sp: GPH_ECOLI | *Escherichia coli* K12 gph | 26.0 | 54.4 | 204 | phosphoglycolate phosphatase |
| 2454 | 5954 | 2375214 | 2375684 | 471 | sp: PTPA_STRCO | *Streptomyces coelicolor* A3(2) SCQ11.04c ptpA | 46.2 | 63.5 | 156 | low molecular weight protein-tyrosine-phosphatase |
| 2455 | 5955 | 2375767 | 2376720 | 954 | sp: Y01G_MYCTU | *Mycobacterium tuberculosis* H37Rv Rv2235 | 40.9 | 65.5 | 281 | hypothetical protein |
| 2456 | 5956 | 2377390 | 2376998 | 393 | sp: YI21_BURCE | *Burkholderia cepacia* | 32.6 | 56.6 | 129 | insertion element (IS402) |
| 2457 | 5957 | 2377726 | 2377484 | 243 | | | | | | |
| 2458 | 5958 | 2377899 | 2378276 | 378 | gp: SC8F4_22 | *Streptomyces coelicolor* A3(2) SC8F4.22c | 30.4 | 57.8 | 135 | transcriptional regulator |
| 2459 | 5959 | 2378292 | 2378489 | 198 | | | | | | |
| 2460 | 5960 | 2379312 | 2378884 | 429 | sp: Y01K_MYCTU | *Mycobacterium tuberculosis* H37Rv Rv2239c | 55.2 | 77.6 | 134 | hypothetical protein |
| 2461 | 5961 | 2379426 | 2379770 | 345 | | | | | | |
| 2462 | 5962 | 2380033 | 2382744 | 2712 | gp: AF047034_4 | *Streptomyces seoulensis* pdhA | 55.9 | 78.9 | 910 | pyruvate dehydrogenase component |
| 2463 | 5963 | 2382240 | 2380765 | 1476 | | | | | | |
| 2464 | 5964 | 2383615 | 2382827 | 789 | sp: GLNQ_ECOLI | *Escherichia coli* K12 glnQ | 33.7 | 62.8 | 261 | ABC transporter or glutamine transport ATP-binding protein |
| 2465 | 5965 | 2384464 | 2385426 | 963 | sp: RBSC_BACSU | *Bacillus subtilis* 168 rbsC | 25.4 | 58.7 | 283 | ribose transport system permease protein |
| 2466 | 5966 | 2384509 | 2383622 | 888 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2467 | 5967 | 2385447 | 2384509 | 939 | pir: H71693 | *Rickettsia prowazekii* Madrid E RP367 | 26.2 | 62.9 | 286 | hypothetical protein |
| 2468 | 5968 | 2385771 | 2386580 | 810 | sp: CBPA_DICDI | *Dictyostelium discoideum* AX2 cbpA | 41.6 | 55.2 | 125 | calcium binding protein |
| 2469 | 5969 | 2386284 | 2385913 | 372 | | | | | | |
| 2470 | 5970 | 2387627 | 2386614 | 1014 | gp: SC6G4_24 | *Streptomyces coelicolor* A3(2) SC6G4.24 | 29.6 | 55.7 | 352 | lipase or hydrolase |
| 2471 | 5971 | 2387667 | 2387957 | 291 | sp: ACP_MYXXA | *Myxococcus xanthus* ATCC 25232 acpP | 42.7 | 80.0 | 75 | acyl carrier protein |
| 2472 | 5972 | 2387997 | 2388821 | 825 | sp: NAGD_ECOLI | *Escherichia coli* K12 nagD | 43.9 | 75.5 | 253 | N-acetylglucosamine-6-phosphate deacetylase |
| 2473 | 5973 | 2388838 | 2389869 | 1032 | gp: AE001968_4 | *Deinococcus radiodurans* DR1192 | 33.6 | 65.7 | 289 | hypothetical protein |
| 2474 | 5974 | 2390904 | 2390434 | 471 | | | | | | |
| 2475 | 5975 | 2392008 | 2391184 | 825 | gp: SC4A7_8 | *Streptomyces coelicolor* A3(2) SC4A7.08 | 52.4 | 75.3 | 271 | hypothetical protein |
| 2476 | 5976 | 2392566 | 2392075 | 492 | | | | | | |
| 2477 | 5977 | 2393349 | 2392579 | 771 | | | | | | |
| 2478 | 5978 | 2393425 | 2393970 | 546 | | | | | | |
| 2479 | 5979 | 2394437 | 2393973 | 465 | | | | | | |
| 2480 | 5980 | 2394594 | 2394935 | 342 | | | | | | |
| 2481 | 5981 | 2395204 | 2396763 | 1560 | sp: PPBD_BACSU | *Bacillus subtilis* 168 phoD | 34.2 | 64.7 | 530 | alkaline phosphatase D precursor |
| 2482 | 5982 | 2395986 | 2395273 | 714 | gp: SCI51_17 | *Streptomyces coelicolor* A3(2) SCI51.17 | 44.4 | 73.1 | 594 | hypothetical protein |
| 2483 | 5983 | 2397264 | 2399099 | 1836 | pir: G70661 | *Mycobacterium tuberculosis* H37Rv Rv2342 | 41.2 | 72.1 | 68 | hypothetical protein |
| 2484 | 5984 | 2399158 | 2399397 | 240 | | | | | | |
| 2485 | 5985 | 2400342 | 2399668 | 675 | prf: 2413330B | *Mycobacterium smegmatis* dnaG | 59.1 | 82.9 | 633 | DNA primase |
| 2486 | 5986 | 2401303 | 2399405 | 1899 | gp: XXU394467_1 | *Streptomyces aureofaciens* BMK | 49.0 | 67.4 | 98 | ribonuclease Sa |
| 2487 | 5987 | 2401373 | 2401834 | 462 | gp: AF058788_1 | *Mycobacterium smegmatis* mc2155 glmS | 59.1 | 82.2 | 636 | L-glutamine: D-fructose-6-phosphate amidotransferase |
| 2488 | 5988 | 2401838 | 2402080 | 243 | | | | | | |
| 2489 | 5989 | 2403165 | 2402530 | 636 | | | | | | |
| 2490 | 5990 | 2404012 | 2402144 | 1869 | prf: 2413330A | *Mycobacterium smegmatis* dgt | 54.6 | 76.3 | 414 | deoxyguanosinetriphosphate triphosphohydrolase |
| 2491 | 5991 | 2404523 | 2404846 | 324 | gp: NMA1Z2491_235 | *Neisseria meningitidis* NMA0251 | 30.4 | 59.7 | 171 | hypothetical protein |
| 2492 | 5992 | 2405671 | 2406822 | 1152 | pir: B70662 | *Mycobacterium tuberculosis* H37Rv Rv2345 | 31.1 | 63.6 | 692 | hypothetical protein |
| 2493 | 5993 | 2406258 | 2404987 | 1272 | | | | | | |
| 2494 | 5994 | 2406936 | 2406262 | 675 | gp: AE003565_26 | *Drosophila melanogaster* CG10592 | 24.6 | 54.4 | 138 | hypothetical protein |
| 2495 | 5995 | 2406993 | 2409029 | 2037 | | | | | | |
| 2496 | 5996 | 2410264 | 2409779 | 486 | | | | | | |
| 2497 | 5997 | 2410861 | 2410280 | 582 | pir: S58522 | *Thermus aquaticus* HB8 | 46.1 | 69.9 | 508 | glycyl-tRNA synthetase |
| 2498 | 5998 | 2412338 | 2410956 | 1383 | pir: E70585 | *Mycobacterium tuberculosis* H37Rv Rv2358 furB | 49.4 | 73.0 | 89 | bacterial regulatory protein, arsR family |
| 2499 | 5999 | 2412580 | 2412948 | 369 | | | | | | |
| 2500 | 6000 | 2412992 | 2413423 | 432 | sp: FUR_ECOLI | *Escherichia coli* K12 fur | 34.9 | 70.5 | 132 | ferric uptake regulation protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2501 | 6001 | 2413568 | 2415118 | 1551 | pir: A70539 | Mycobacterium tuberculosis H37Rv Rv1128c | 24.8 | 46.7 | 529 | hypothetical protein (conserved in C. glutamicum?) |
| 2502 | 6002 | 2416089 | 2415298 | 792 | gp: AF162938_1 | Streptomyces coelicolor A3(2) h3u | 40.6 | 67.0 | 224 | hypothetical membrane protein |
| 2503 | 6003 | 2417099 | 2416371 | 729 | sp: UPPS_MICLU | Micrococcus luteus B-P 26 uppS | 43.4 | 71.2 | 233 | undecaprenyl diphosphate synthase |
| 2504 | 6004 | 2417947 | 2417222 | 726 | pir: A70586 | Mycobacterium tuberculosis H37Rv Rv2362c | 45.7 | 74.3 | 245 | hypothetical protein |
| 2505 | 6005 | 2418883 | 2417969 | 915 | gp: AF072811_1 | Streptococcus pneumoniae era | 39.5 | 70.3 | 296 | Era-like GTP-binding protein |
| 2506 | 6006 | 2420309 | 2418990 | 1320 | sp: Y1DE_MYCTU | Mycobacterium tuberculosis H37Rv Rv2366 | 52.8 | 82.4 | 432 | hypothetical membrane protein |
| 2507 | 6007 | 2420900 | 2420313 | 588 | sp: YN67_MYCTU | Mycobacterium tuberculosis H37Rv Rv2367c | 65.0 | 86.0 | 157 | hypothetical protein |
| 2508 | 6008 | 2420973 | 2421236 | 264 | GSP: Y75650 | Neisseria meningitidis | 45.0 | 50.0 | 85 | Neisserial polypeptides predicted to be useful antigens for vaccines and diagnostics |
| 2509 | 6009 | 2421949 | 2420900 | 1050 | sp: PHOL_MYCTU | Mycobacterium tuberculosis H37Rv Rv2368c phoH | 61.1 | 84.6 | 344 | phosphate starvation inducible protein |
| 2510 | 6010 | 2422697 | 2421975 | 723 | gp: SCC77_19 | Streptomyces coelicolor A3(2) SCC77.19c. | 44.0 | 75.4 | 248 | hypothetical protein |
| 2511 | 6011 | 2422850 | 2423791 | 942 | prf: 2421342B | Streptomyces albus dnaJ2 | 47.1 | 77.4 | 380 | heat shock protein dnaJ |
| 2512 | 6012 | 2423845 | 2422700 | 1146 | prf: 2421342A | Streptomyces albus hrcA | 48.2 | 79.6 | 334 | heat-inducible transcriptional repressor (groEL repressor) |
| 2513 | 6013 | 2424937 | 2423915 | 1023 | | | | | | |
| 2514 | 6014 | 2425954 | 2424965 | 990 | prf: 2318256A | Bacillus stearothermophilus hemN | 33.1 | 64.1 | 320 | oxygen-independent coproporphyrinogen III oxidase |
| 2515 | 6015 | 2426181 | 2426699 | 519 | sp: AGA1_YEAST | Saccharomyces cerevisiae YNR044W AGA1 | 36.6 | 64.9 | 134 | agglutinin attachment subunit precursor |
| 2516 | 6016 | 2427468 | 2426776 | 693 | | | | | | |
| 2517 | 6017 | 2428184 | 2427807 | 378 | | | | | | |
| 2518 | 6018 | 2430028 | 2428184 | 1845 | gp: SC6G10_4 | Streptomyces coelicolor A3(2) SC6G10.04 | 48.0 | 75.1 | 611 | long-chain-fatty-acid—CoA ligase |
| 2519 | 6019 | 2430296 | 2432413 | 2118 | sp: MALQ_ECOLI | Escherichia coli K12 malQ | 28.3 | 55.4 | 738 | 4-alpha-glucanotransferase |
| 2520 | 6020 | 2432508 | 2434370 | 1863 | gp: AB005752_1 | Lactobacillus brevis plasmid horA | 29.5 | 64.4 | 604 | ABC transporter, Hop-Resistance protein |
| 2521 | 6021 | 2433868 | 2433614 | 255 | GSP: Y74827 | Neisseria gonorrhoeae | 44.0 | 51.0 | 68 | Neisserial polypeptides predicted to be useful antigens for vaccines and diagnostics |
| 2522 | 6022 | 2434207 | 2433875 | 333 | GSP: Y74829 | Neisseria meningitidis | 47.0 | 53.0 | 107 | polypeptides predicted to be useful antigens for vaccines and diagnostics |
| 2523 | 6023 | 2434619 | 2434440 | 180 | | | | | | |
| 2524 | 6024 | 2434776 | 2434573 | 204 | | | | | | |
| 2525 | 6025 | 2436838 | 2434805 | 2034 | sp: DCP_SALTY | Salmonella typhimurium dcp | 40.3 | 68.3 | 690 | peptidyl-dipeptidase |
| 2526 | 6026 | 2436871 | 2438049 | 1179 | gp: AF064523_1 | Anisopteromalus calandrae | 24.1 | 45.7 | 453 | carboxylesterase |
| 2527 | 6027 | 2438113 | 2439906 | 1794 | pir: G70983 | Mycobacterium tuberculosis H37Rv Rv0126 | 65.2 | 84.9 | 594 | glycosyl hydrolase or trehalose synthase |
| 2528 | 6028 | 2439906 | 2440994 | 1089 | pir: H70983 | Mycobacterium tuberculosis H37Rv Rv0127 | 32.1 | 58.8 | 449 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2529 | 6029 | 2441589 | 2441005 | 585 | pir: T07979 | Chlamydomonas reinhardtii ipi1 | 31.8 | 57.7 | 189 | isopentenyl-diphosphate Delta-isomerase |
| 2530 | 6030 | 2441669 | 2441890 | 222 | | | | | | |
| 2531 | 6031 | 2442355 | 2442792 | 438 | | | | | | |
| 2532 | 6032 | 2443356 | 2441602 | 1755 | | | | | | |
| 2533 | 6033 | 2444015 | 2443356 | 660 | | | | | | |
| 2534 | 6034 | 2444551 | 2444033 | 519 | | | | | | |
| 2535 | 6035 | 2444735 | 2445709 | 975 | gp: CORCSLYS_1 | Corynebacterium glutamicum ATCC 13032 aecD | 99.4 | 100.0 | 325 | beta C-S lyase (degradation of aminoethylcysteine) |
| 2536 | 6036 | 2445716 | 2446993 | 1278 | sp: BRNQ_CORGL | Corynebacterium glutamicum ATCC 13032 brnQ | 99.8 | 100.0 | 426 | branched-chain amino acid transport system carrier protein (isoleucine uptake) |
| 2537 | 6037 | 2447021 | 2447998 | 978 | sp: LUXA_VIBHA | Vibrio harveyi luxA | 21.6 | 49.0 | 343 | alkanal monooxygenase alpha chain |
| 2538 | 6038 | 2450844 | 2450323 | 522 | | | | | | |
| 2539 | 6039 | 2451785 | 2450859 | 927 | gp: AF155772_2 | SinoRhizobium meliloti mdcF | 25.9 | 60.5 | 324 | malonate transporter |
| 2540 | 6040 | 2454637 | 2451794 | 2844 | sp: GLCD_ECOLI | Escherichia coli K12 glcD | 27.7 | 55.1 | 483 | glycolate oxidase subunit |
| 2541 | 6041 | 2454725 | 2455435 | 711 | sp: YDFH_ECOLI | Escherichia coli K12 ydfH | 25.6 | 65.0 | 203 | transcriptional regulator |
| 2542 | 6042 | 2455733 | 2455452 | 282 | | | | | | |
| 2543 | 6043 | 2457066 | 2455720 | 1347 | sp: YGIK_SALTY | Salmonella typhimurium ygiK | 22.5 | 57.6 | 467 | hypothetical protein |
| 2544 | 6044 | 2457759 | 2457337 | 423 | | | | | | |
| 2545 | 6045 | 2457863 | 2459371 | 1509 | sp: HBPA_HAEIN | Haemophilus influenzae Rd HI0853 hbpA | 27.5 | 55.5 | 546 | heme-binding protein A precursor (hemin-binding lipoprotein) |
| 2546 | 6046 | 2459371 | 2460336 | 966 | sp: APPB_BACSU | Bacillus subtilis 168 appB | 40.0 | 73.3 | 315 | oligopeptide ABC transporter (permease) |
| 2547 | 6047 | 2460340 | 2461167 | 828 | sp: DPPC_ECOLI | Escherichia coli K12 dppC | 43.2 | 74.5 | 271 | dipeptide transport system permease protein |
| 2548 | 6048 | 2461163 | 2462599 | 1437 | prf: 2306258MR | | 37.4 | 66.4 | 372 | oligopeptide transport ATP-binding protein |
| 2549 | 6049 | 2462049 | 2461543 | 507 | PIR: G72536 | Aeropyrum pernix K1 APE1580 | 35.0 | 44.0 | 106 | hypothetical protein |
| 2550 | 6050 | 2463150 | 2462602 | 549 | pir: D70367 | Aquifex aeolicus VF5 aq_768 | 29.3 | 58.0 | 157 | hypothetical protein |
| 2551 | 6051 | 2463241 | 2464143 | 903 | prf: 2514301A | Rhizobium etli rbsK | 41.0 | 65.0 | 300 | ribose kinase |
| 2552 | 6052 | 2464344 | 2465768 | 1425 | gp: SCM2_16 | Streptomyces coelicolor A3(2) SCM2.16c | 39.9 | 64.6 | 466 | hypothetical membrane protein |
| 2553 | 6053 | 2465767 | 2465465 | 303 | | | | | | |
| 2554 | 6054 | 2467009 | 2466038 | 972 | sp: NTCL_HUMAN | Homo sapiens | 31.3 | 61.6 | 284 | sodium-dependent transporter or odium Bile acid symporter family |
| 2555 | 6055 | 2467077 | 2467922 | 846 | gp: AF195243_1 | Chlamydomonas reinhardtii | 28.5 | 51.2 | 295 | apospory-associated protein C |
| 2556 | 6056 | 2470313 | 2470678 | 366 | | | | | | |
| 2557 | 6057 | 2472250 | 2472819 | 570 | sp: THIX_CORGL | Corynebacterium glutamicum ATCC 13032 thiX | 100.0 | 100.0 | 133 | thiamine biosynthesis protein x |
| 2558 | 6058 | 2473480 | 2472893 | 588 | sp: VG66_BPMD | Mycobacteriophage D29 66 | 42.6 | 65.5 | 197 | hypothetical protein |
| 2559 | 6059 | 2473653 | 2475542 | 1890 | sp: BETP_CORGL | Corynebacterium glutamicum ATCC 13032 betP | 39.8 | 71.7 | 601 | glycine betaine transporter |
| 2560 | 6060 | 2476497 | 2477492 | 996 | | | | | | |
| 2561 | 6061 | 2477644 | 2479251 | 1608 | | | | | | |
| 2562 | 6062 | 2479379 | 2479762 | 384 | | | | | | |
| 2563 | 6063 | 2481208 | 2479898 | 1311 | prf: 2320266C | Rhodobacter capsulatus dctM | 34.6 | 71.9 | 448 | large integral C4-dicarboxylate membrane transport protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2564 | 6064 | 2481692 | 2481213 | 480 | gp: AF186091_1 | Klebsiella pneumoniae dctQ | 33.9 | 73.7 | 118 | small integral C4-dicarboxylate membrane transport protein |
| 2565 | 6065 | 2482480 | 2481734 | 747 | sp: DCTP_RHOCA | Rhodobacter capsulatus B10 dctP | 28.2 | 59.0 | 227 | C4-dicarboxylate-binding periplasmic protein precursor |
| 2566 | 6066 | 2483845 | 2484087 | 243 | PRF: 1806416A | Lycopersicon esculentum (tomato) | 63.0 | 73.0 | 46 | extensin I |
| 2567 | 6067 | 2484392 | 2482548 | 1845 | sp: LEPA_BACSU | Bacillus subtilis 168 lepA | 58.7 | 83.6 | 603 | GTP-binding protein |
| 2568 | 6068 | 2484661 | 2485269 | 609 | pir: H70683 | Mycobacterium tuberculosis H37Rv Rv2405 | 41.6 | 69.7 | 185 | hypothetical protein |
| 2569 | 6069 | 2485473 | 2485733 | 261 | sp: RS20_ECOLI | Escherichia coli K12 rpsT | 48.2 | 72.9 | 85 | 30S ribosomal protein S20 |
| 2570 | 6070 | 2486469 | 2485801 | 669 | sp: RHTC_ECOLI | Escherichia coli K12 rhtC | 30.0 | 67.1 | 210 | threonine efflux protein |
| 2571 | 6071 | 2486881 | 2486477 | 405 | gp: SC6D7_25 | Streptomyces coelicolor A3(2) SC6D7.25. | 61.2 | 80.6 | 129 | ankyrin-like protein |
| 2572 | 6072 | 2487884 | 2486910 | 975 | pir: H70684 | Mycobacterium tuberculosis H37Rv Rv2413c | 46.0 | 74.1 | 313 | hypothetical protein |
| 2573 | 6073 | 2489450 | 2487912 | 1539 | sp: CME3_BACSU | Bacillus subtilis 168 comEC | 21.4 | 49.7 | 527 | late competence operon required for DNA binding and uptake |
| 2574 | 6074 | 2490154 | 2489573 | 582 | sp: CME1_BACSU | Bacillus subtilis 168 comEA | 30.8 | 63.6 | 195 | late competence operon required for DNA binding and uptake |
| 2575 | 6075 | 2490911 | 2491732 | 822 | gp: SCC123_7 | Streptomyces coelicolor A3(2) SCC123.07c. | 34.8 | 66.3 | 273 | hypothetical protein |
| 2576 | 6076 | 2491111 | 2490290 | 822 | | | | | | |
| 2577 | 6077 | 2491858 | 2491151 | 708 | pir: F70685 | Mycobacterium tuberculosis H37Rv Rv2419c | 46.8 | 66.4 | 235 | phosphoglycerate mutase |
| 2578 | 6078 | 2492343 | 2491873 | 471 | pir: G70685 | Mycobacterium tuberculosis H37Rv Rv2420c | 55.6 | 86.3 | 117 | hypothetical protein |
| 2579 | 6079 | 2493178 | 2492501 | 678 | gp: SCC123_17 | Streptomyces coelicolor A3(2) SCC123.17c. | 68.0 | 85.3 | 197 | hypothetical protein |
| 2580 | 6080 | 2494237 | 2493215 | 1023 | sp: PROA_CORGL | Corynebacterium glutamicum ATCC 17965 proA | 99.1 | 99.8 | 432 | gamma-glutamyl phosphate reductase or glutamate-5-semialdehyde dehydrogenase |
| 2581 | 6081 | 2495634 | 2494339 | 1296 | | | | | | |
| 2582 | 6082 | 2496607 | 2495696 | 912 | sp: YPRA_CORGL | Corynebacterium glutamicum ATCC 17965 unkdh | 99.3 | 100.0 | 304 | D-isomer specific 2-hydroxyacid dehydrogenase |
| 2583 | 6083 | 2496803 | 2497513 | 711 | gp: D87915_1 | Streptomyces coelicolor A3(2) obg | 58.9 | 78.2 | 487 | GTP-binding protein |
| 2584 | 6084 | 2499511 | 2498009 | 1503 | | | | | | |
| 2585 | 6085 | 2499783 | 2501669 | 1887 | sp: PBUX_BACSU | Bacillus subtilis 168 pbuX | 39.1 | 77.3 | 422 | xanthine permease |
| 2586 | 6086 | 2502577 | 2501735 | 843 | pir: I40838 | Corynebacterium sp. ATCC 31090 | 61.2 | 81.9 | 276 | 2,5-diketo-D-gluconic acid reductase |
| 2587 | 6087 | 2502735 | 2503355 | 621 | | | | | | |
| 2588 | 6088 | 2503870 | 2504265 | 396 | | | | | | |
| 2589 | 6089 | 2504247 | 2503984 | 264 | sp: RL27_STRGR | Streptomyces griseus IFO13189 rpmA | 80.3 | 92.6 | 81 | 50S ribosomal protein L27 |
| 2590 | 6090 | 2504602 | 2504300 | 303 | prf: 2304263A | Streptomyces griseus IFO13189 obg | 56.4 | 82.2 | 101 | 50S ribosomal protein L21 |
| 2591 | 6091 | 2507098 | 2504831 | 2268 | sp: RNE_ECOLI | Escherichia coli K12 rne | 30.1 | 56.6 | 886 | ribonuclease E |
| 2592 | 6092 | 2507115 | 2507663 | 549 | | | | | | |
| 2593 | 6093 | 2507138 | 2507710 | 573 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2594 | 6094 | 2508094 | 2508840 | 747 | | | 61.0 | 82.6 | 195 | hypothetical protein |
| 2595 | 6095 | 2508922 | 2509530 | 609 | gp: SCF76_8 | *Streptomyces coelicolor* A3(2) SCF76.08c | 99.1 | 100.0 | 436 | transposase (insertion sequence IS31831) |
| 2596 | 6096 | 2510830 | 2509523 | 1308 | plr: S43613 | *Corynebacterium glutamicum* ATCC 31831 | 51.3 | 76.9 | 117 | hypothetical protein |
| 2597 | 6097 | 2511046 | 2511423 | 378 | gp: SCF76_8 | *Streptomyces coelicolor* A3(2) SCF76.08c. | 37.8 | 67.8 | 143 | hypothetical protein |
| 2598 | 6098 | 2511427 | 2511876 | 450 | gp: SCF76_9 | *Streptomyces coelicolor* A3(2) SCF76.09 | 70.9 | 89.6 | 134 | nucleoside diphosphate kinase |
| 2599 | 6099 | 2512356 | 2511949 | 408 | gp: AF069544_1 | *Mycobacterium smegmatis* ndk | 34.8 | 67.4 | 92 | hypothetical protein |
| 2600 | 6100 | 2512768 | 2512409 | 360 | gp: AE002024_10 | *Deinococcus radiodurans* R1 DR1844 | | | | hypothetical protein |
| 2601 | 6101 | 2512803 | 2513144 | 342 | | | | | | |
| 2602 | 6102 | 2513618 | 2513154 | 465 | pir: H70515 | *Mycobacterium tuberculosis* H37Rv Rv1883c | 36.6 | 64.3 | 112 | hypothetical protein |
| 2603 | 6103 | 2514114 | 2513692 | 423 | pir: E70863 | *Mycobacterium tuberculosis* H37Rv Rv2446c | 33.9 | 68.6 | 118 | hypothetical protein |
| 2604 | 6104 | 2515487 | 2514114 | 1374 | prf: 2410252B | *Streptomyces coelicolor* A3(2) folC | 55.4 | 79.6 | 451 | folyl-polyglutamate synthetase |
| 2605 | 6105 | 2515662 | 2516273 | 612 | | | | | | |
| 2606 | 6106 | 2516243 | 2516956 | 714 | | | | | | |
| 2607 | 6107 | 2517089 | 2517751 | 663 | | | | | | |
| 2608 | 6108 | 2518336 | 2515637 | 2700 | sp: SYV_BACSU | *Bacillus subtilis* 168 balS | 45.5 | 72.1 | 915 | valyl-tRNA synthetase |
| 2609 | 6109 | 2519972 | 2518398 | 1575 | pir: A38447 | *Bacillus subtilis* 168 oppA | 24.2 | 58.5 | 521 | oligopeptide ABC transport system substrate-binding protein |
| 2610 | 6110 | 2520209 | 2521660 | 1452 | sp: DNAK_BACSU | *Bacillus subtilis* 168 dnaK | 26.2 | 54.9 | 508 | heat shock protein dnaK |
| 2611 | 6111 | 2522251 | 2521667 | 585 | gp: ECU89166_1 | *Eikenella corrodens* ATCC 23824 | 42.9 | 71.2 | 170 | lysine decarboxylase |
| 2612 | 6112 | 2523248 | 2522265 | 984 | sp: MDH_THEFL | *Thermus aquaticus* ATCC 33923 mdh | 56.4 | 76.5 | 319 | malate dehydrogenase |
| 2613 | 6113 | 2523561 | 2524337 | 777 | gp: SC4A10_33 | *Streptomyces coelicolor* A3(2) SC4A10.33 | 24.6 | 56.5 | 207 | transcriptional regulator |
| 2614 | 6114 | 2524915 | 2524340 | 576 | gp: AF065442_1 | *Vibrio cholerae* aphA | 26.0 | 51.4 | 208 | hypothetical protein |
| 2615 | 6115 | 2525099 | 2526226 | 1128 | prf: 2513416F | *Acinetobacter* sp. vanA | 39.5 | 68.6 | 357 | vanillate demethylase (oxygenase) |
| 2616 | 6116 | 2526233 | 2527207 | 975 | gp: FSU12290_2 | *Sphingomonas flava* ATCC 39723 pcpD | 32.8 | 59.2 | 338 | pentachlorophenol 4-monooxygenase reductase |
| 2617 | 6117 | 2527135 | 2528559 | 1425 | prf: 2513416G | *Acinetobacter* sp. vanK | 40.8 | 76.8 | 444 | transport protein |
| 2618 | 6118 | 2529480 | 2528551 | 930 | gp: KPU95087_7 | *Klebsiella pneumoniae* mdcF | 28.0 | 58.4 | 286 | malonate transporter |
| 2619 | 6119 | 2530761 | 2529484 | 1278 | prf: 2303274A | *Bacillus subtilis* clpX | 59.8 | 85.8 | 430 | class-III heat-shock protein or ATP-dependent protease |
| 2620 | 6120 | 2530891 | 2531976 | 1086 | gp: SCF55_28 | *Streptomyces coelicolor* A3(2) SCF55.28c | 45.6 | 73.0 | 366 | hypothetical protein |
| 2621 | 6121 | 2532601 | 2531969 | 633 | gp: AF109386_2 | *Streptomyces* sp. 2065 pcaJ | 63.3 | 85.7 | 210 | succinyl CoA: 3-oxoadipate CoA transferase beta subunit |
| 2622 | 6122 | 2533353 | 2532604 | 750 | gp: AF109386_1 | *Streptomyces* sp. 2065 pcaI | 60.2 | 84.5 | 251 | succinyl CoA: 3-oxoadipate CoA transferase alpha subunit |
| 2623 | 6123 | 2533391 | 2534182 | 792 | prf: 2408324F | *Rhodococcus opacus* 1CP pcaR | 58.2 | 82.5 | 251 | protocatechuate catabolic protein |
| 2624 | 6124 | 2534201 | 2535424 | 1224 | prf: 2411305D | *Ralstonia eutropha* bktB | 44.8 | 71.9 | 406 | beta-ketothiolase |
| 2625 | 6125 | 2535168 | 2534257 | 912 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2626 | 6126 | 2535430 | 2536182 | 753 | prf: 2408324E | Rhodococcus opacus pcaL | 50.8 | 76.6 | 256 | 3-oxoadipate enol-lactone hydrolase and 4-carboxymuconolactone decarboxylase |
| 2627 | 6127 | 2536196 | 2538256 | 2061 | gp: SCM1_10 | Streptomyces coelicolor A3(2) SCM1.10 | 23.6 | 43.0 | 825 | transcriptional regulator |
| 2628 | 6128 | 2538613 | 2538248 | 366 | prf: 2408324E | Rhodococcus opacus pcaL | 78.3 | 89.6 | 115 | 3-oxoadipate enol-lactone hydrolase and 4-carboxymuconolactone decarboxylase |
| 2629 | 6129 | 2539553 | 2540230 | 678 | | | | | | |
| 2630 | 6130 | 2539731 | 2538616 | 1116 | prf: 2408324D | Rhodococcus opacus pcaB | 39.8 | 63.4 | 437 | 3-carboxy-cis, cis-muconate cycloisomerase |
| 2631 | 6131 | 2540320 | 2539709 | 612 | prf: 2408324C | Rhodococcus opacus pcaG | 49.5 | 70.6 | 214 | protocatechuate dioxygenase alpha subunit |
| 2632 | 6132 | 2541024 | 2540335 | 690 | prf: 2408324B | Rhodococcus opacus pcaH | 74.7 | 91.2 | 217 | protocatechuate dioxygenase beta subunit |
| 2633 | 6133 | 2542350 | 2541187 | 1164 | pir: G70506 | Mycobacterium tuberculosis H37Rv Rv0336 | 26.4 | 48.7 | 273 | hypothetical protein |
| 2634 | 6134 | 2542802 | 2542512 | 291 | prf: 2515333B | Mycobacterium tuberculosis catC | 54.4 | 81.5 | 92 | muconolactone isomerase |
| 2635 | 6135 | 2543043 | 2543813 | 771 | | | | | | |
| 2636 | 6136 | 2543936 | 2542818 | 1119 | sp: CATB_RHOOP | Rhodococcus opacus 1CP catB | 60.8 | 84.7 | 372 | muconate cycloisomerase |
| 2637 | 6137 | 2544262 | 2544867 | 606 | | | | | | |
| 2638 | 6138 | 2544876 | 2544022 | 855 | prf: 2503218A | Rhodococcus rhodochrous catA | 72.3 | 88.4 | 285 | catechol 1,2-dioxygenase |
| 2639 | 6139 | 2545068 | 2544928 | 141 | | | | | | |
| 2640 | 6140 | 2545315 | 2546784 | 1470 | gp: AF134348_1 | Pseudomonas putida pDK1 xylX | 62.2 | 85.6 | 437 | toluate 1,2 dioxygenase subunit |
| 2641 | 6141 | 2546827 | 2547318 | 492 | gp: AF134348_2 | Pseudomonas putida pDK1 xylY | 60.3 | 83.2 | 161 | toluate 1,2 dioxygenase subunit |
| 2642 | 6142 | 2547333 | 2548868 | 1536 | gp: AF134348_3 | Pseudomonas putida pDK1 xylZ | 51.5 | 81.0 | 342 | toluate 1,2 dioxygenase subunit |
| 2643 | 6143 | 2548868 | 2549695 | 828 | gp: AF134348_4 | Pseudomonas putida pDK1 xylL | 30.7 | 61.4 | 277 | 1,2-dihydroxycyclohexa-3,5-diene carboxylate dehydrogenase |
| 2644 | 6144 | 2549771 | 2552455 | 2685 | gp: REU95170_1 | Rhodococcus erythropolis thcG | 23.3 | 48.6 | 979 | regulator of LuxR family with ATP-binding site |
| 2645 | 6145 | 2552563 | 2553942 | 1380 | sp: PCAK_ACICA | Acinetobacter calcoaceticus pcaK | 31.3 | 64.4 | 435 | transmembrane transport protein or 4-hydroxybenzoate transporter |
| 2646 | 6146 | 2554026 | 2555267 | 1242 | sp: BENE_ACICA | Acinetobacter calcoaceticus benE | 29.9 | 66.2 | 388 | benzoate membrane transport protein |
| 2647 | 6147 | 2555940 | 2555317 | 624 | gp: AF071885_2 | Streptomyces coelicolor M145 clpP2 | 69.5 | 88.3 | 197 | ATP-dependent Clp protease proteolytic subunit 2 |
| 2648 | 6148 | 2556580 | 2555978 | 603 | gp: AF071885_1 | Streptomyces coelicolor M145 clpP1 | 62.1 | 85.9 | 198 | ATP-dependent Clp protease proteolytic subunit 1 |
| 2649 | 6149 | 2556599 | 2556748 | 150 | gp: SIS243537_4 | Sulfolobus islandicus ORF154 | 42.9 | 71.4 | 42 | hypothetical protein |
| 2650 | 6150 | 2558106 | 2556760 | 1347 | sp: TIG_BACSU | Bacillus subtilis 168 tig | 32.1 | 66.4 | 417 | trigger factor (prolyl isomerase) (chaperone protein) |
| 2651 | 6151 | 2558609 | 2559103 | 495 | gp: SCD25_17 | Streptomyces coelicolor A3(2) SCD25.17 | 32.5 | 63.1 | 160 | hypothetical protein |
| 2652 | 6152 | 2559157 | 2560131 | 975 | sp: PBP4_NOCLA | Nocardia lactamdurans LC411 pbp | 25.3 | 50.9 | 336 | penicillin-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2653 | 6153 | 2560131 | 2560586 | 456 | prf: 2301342A | Mus musculus Moa1 | 27.8 | 58.3 | 115 | hypothetical protein |
| 2654 | 6154 | 2561115 | 2561363 | 249 | | | | | | |
| 2655 | 6155 | 2561920 | 2561483 | 438 | prf: 2513302C | Corynebacterium striatum ORF1 | 54.2 | 73.2 | 142 | transposase |
| 2656 | 6156 | 2562093 | 2562242 | 150 | | | | | | |
| 2657 | 6157 | 2562115 | 2561990 | 126 | prf: 2513302C | Corynebacterium striatum ORF1 | 57.1 | 82.9 | 35 | hypothetical protein |
| 2658 | 6158 | 2562341 | 2562078 | 264 | prf: 2513302C | Corynebacterium striatum ORF1 | 50.7 | 78.7 | 75 | transposase |
| 2659 | 6159 | 2562776 | 2562387 | 390 | | | | | | |
| 2660 | 6160 | 2562963 | 2563847 | 885 | | | | | | |
| 2661 | 6161 | 2564402 | 2563932 | 471 | sp: LACB_STAAU | Staphylococcus aureus NCTC 8325-4 lacB | 40.0 | 71.4 | 140 | galactose-6-phosphate isomerase |
| 2662 | 6162 | 2565245 | 2564550 | 696 | sp: YAMY_BACAD | Bacillus acidopullulyticus ORF2 | 26.2 | 58.1 | 248 | hypothetical protein |
| 2663 | 6163 | 2566231 | 2565623 | 609 | pir: A70866 | Mycobacterium tuberculosis H37Rv Rv2466c | 56.8 | 80.9 | 199 | hypothetical protein |
| 2664 | 6164 | 2566345 | 2568945 | 2601 | sp: AMPN_STRLI | Streptomyces lividans pepN | 47.5 | 70.5 | 890 | aminopeptidase N |
| 2665 | 6165 | 2569211 | 2570293 | 1083 | pir: B70206 | Borrelia burgdorferi BB0852 | 25.1 | 58.1 | 358 | hypothetical protein |
| 2666 | 6166 | 2571460 | 2570309 | 1152 | | | | | | |
| 2667 | 6167 | 2571510 | 2572175 | 666 | | | | | | |
| 2668 | 6168 | 2572193 | 2572348 | 156 | | | | | | |
| 2669 | 6169 | 2572677 | 2572351 | 327 | gp: AF139916_3 | Brevibacterium linens ATCC 9175 crtI | 61.5 | 81.7 | 104 | phytoene desaturase |
| 2670 | 6170 | 2572977 | 2572807 | 171 | | | | | | |
| 2671 | 6171 | 2573770 | 2573393 | 378 | | | | | | |
| 2672 | 6172 | 2573864 | 2572659 | 1206 | sp: CRTI_MYXXA | Myxococcus xanthus DK1050 carA2 | 31.2 | 63.8 | 381 | phytoene dehydrogenase |
| 2673 | 6173 | 2574718 | 2573843 | 876 | sp: CRTB_STRGR | Streptomyces griseus JA3933 crtB | 31.4 | 58.6 | 290 | phytoene synthase |
| 2674 | 6174 | 2575898 | 2574780 | 1119 | gp: LMAJ9627_3 | Listeria monocytogenes lltB | 25.8 | 47.7 | 392 | multidrug resistance transporter |
| 2675 | 6175 | 2577213 | 2575981 | 1233 | | | | | | |
| 2676 | 6176 | 2578872 | 2577232 | 1641 | gp: SYOATPBP_2 | Synechococcus elongatus | 41.3 | 71.6 | 538 | ABC transporter ATP-binding protein |
| 2677 | 6177 | 2579760 | 2578879 | 882 | sp: DPPC_BACFI | Bacillus firmus OF4 dppC | 38.8 | 73.8 | 286 | dipeptide transport system permease protein |
| 2678 | 6178 | 2580707 | 2579769 | 939 | pir: S47696 | Escherichia coli K12 nikB | 33.2 | 62.0 | 316 | nickel transport system permease protein |
| 2679 | 6179 | 2582417 | 2580711 | 1707 | | | | | | |
| 2680 | 6180 | 2582564 | 2584504 | 1941 | | | | | | |
| 2681 | 6181 | 2584613 | 2585926 | 1314 | sp: ARGD_CORGL | Corynebacterium glutamicum ATCC 13032 argD | 31.4 | 63.5 | 411 | acetylornithine aminotransferase |
| 2682 | 6182 | 2586180 | 2587763 | 1584 | pir: A70539 | Mycobacterium tuberculosis H37Rv Rv1128c | 25.1 | 47.9 | 482 | hypothetical protein |
| 2683 | 6183 | 2587976 | 2588722 | 747 | sp: YA26_MYCTU | Mycobacterium tuberculosis H37Rv Rv0364 | 49.1 | 79.4 | 218 | hypothetical membrane protein |
| 2684 | 6184 | 2589432 | 2588725 | 708 | sp: PHBB_CHRVI | Chromatium vinosum D phbB | 28.1 | 60.0 | 235 | acetoacetyl CoA reductase |
| 2685 | 6185 | 2589565 | 2590302 | 738 | pir: A40046 | Streptomyces coelicolor actII | 26.7 | 55.0 | 240 | transcriptional regulator, TetR family |
| 2686 | 6186 | 2590697 | 2591137 | 441 | GSP: Y74375 | Neisseria meningitidis | 38.0 | 47.0 | 94 | polypeptides predicted to be useful antigens for vaccines and diagnostics |
| 2687 | 6187 | 2592365 | 2591574 | 792 | gp: AF106002_1 | Pseudomonas putida GM73 ttg2A | 31.1 | 65.1 | 238 | ABC transporter ATP-binding protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2688 | 6188 | 2592402 | 2592794 | 393 | gp: MLCB1610_9 | *Mycobacterium leprae* MLCB1610.14c | 53.2 | 77.0 | 126 | globin |
| 2689 | 6189 | 2592838 | 2593965 | 1128 | sp: CHRA_PSEAE | *Pseudomonas aeruginosa* Plasmid pUM505 chrA | 27.3 | 60.4 | 396 | chromate transport protein |
| 2690 | 6190 | 2594594 | 2593968 | 627 | pir: A70867 | *Mycobacterium tuberculosis* H37Rv Rv2474c | 37.8 | 68.9 | 196 | hypothetical protein |
| 2691 | 6191 | 2595061 | 2594597 | 465 | gp: SC6D10_19 | *Streptomyces coelicolor* A3(2) SC6D10.19c | 36.2 | 61.4 | 127 | hypothetical protein |
| 2692 | 6192 | 2595808 | 2595188 | 621 | pir: B72589 | *Aeropyrum pernix* K1 APE1182 | 36.4 | 60.0 | 55 | hypothetical protein |
| 2693 | 6193 | 2595983 | 2595822 | 162 | sp: YJJK_ECOLI | *Escherichia coli* K12 yjjK | 52.8 | 79.6 | 563 | ABC transporter ATP-binding protein |
| 2694 | 6194 | 2597715 | 2596048 | 1668 | pir: E70867 | *Mycobacterium tuberculosis* H37Rv Rv2478c | 31.4 | 62.2 | 172 | hypothetical protein |
| 2695 | 6195 | 2598483 | 2597869 | 615 | | | | | | |
| 2696 | 6196 | 2600764 | 2598662 | 2103 | sp: Y05L_MYCLE | *Mycobacterium leprae* o659 | 28.0 | 56.7 | 700 | hypothetical membrane protein |
| 2697 | 6197 | 2601461 | 2602879 | 1419 | pir: C69676 | *Bacillus subtilis* phoB | 28.0 | 52.6 | 536 | alkaline phosphatase |
| 2698 | 6198 | 2604573 | 2605502 | 930 | | | | | | |
| 2699 | 6199 | 2604583 | 2603945 | 639 | | | | | | |
| 2700 | 6200 | 2605520 | 2604609 | 912 | sp: MSMG_STRMU | *Streptococcus mutans* INGBRITT msmG | 39.1 | 76.3 | 279 | multiple sugar-binding transport system permease protein |
| 2701 | 6201 | 2606369 | 2605527 | 843 | sp: MSMF_STRMU | *Streptococcus mutans* INGBRITT msmF | 27.4 | 67.5 | 292 | multiple sugar-binding transport system permease protein |
| 2702 | 6202 | 2606444 | 2608117 | 1674 | prf: 2206392C | *Thermoanaerobacterium thermosul* amyE | 28.8 | 63.2 | 462 | maltose-binding protein |
| 2703 | 6203 | 2607889 | 2606561 | 1329 | | | | | | |
| 2704 | 6204 | 2609426 | 2608185 | 1242 | prf: 2308356A | *Streptomyces reticuli* msiK | 59.1 | 79.8 | 386 | ABC transporter ATP-binding protein (ABC-type sugar transport protein) or cellobiose/maltose transport protein |
| 2705 | 6205 | 2610639 | 2609512 | 1128 | | | | | | |
| 2706 | 6206 | 2611523 | 2612272 | 750 | prf: 2317468A | *Schizosaccharomyces pombe* dpm1 | 37.7 | 72.7 | 154 | dolichol phosphate mannose synthase |
| 2707 | 6207 | 2611531 | 2610848 | 684 | | | | | | |
| 2708 | 6208 | 2612462 | 2613151 | 690 | prf: 2516398E | *Rhodococcus rhodochrous* plasmid pRTL1 orf5 | 67.2 | 89.4 | 207 | aldehyde dehydrogenase |
| 2709 | 6209 | 2613712 | 2614500 | 789 | | | | | | |
| 2710 | 6210 | 2614649 | 2615410 | 762 | prf: 2513418A | *Synechococcus* sp. PCC7942 cpmA | 48.6 | 73.8 | 183 | circadian phase modifier |
| 2711 | 6211 | 2615451 | 2615795 | 345 | pir: A72312 | *Thermotoga maritima* MSB8 TM0964 | 35.0 | 64.6 | 412 | hypothetical membrane protein |
| 2712 | 6212 | 2617120 | 2615939 | 1182 | | | | | | |
| 2713 | 6213 | 2617246 | 2617995 | 750 | sp: GIP_ECOLI | *Escherichia coli* K12 gip | 41.2 | 69.4 | 255 | glyoxylate-induced protein |
| 2714 | 6214 | 2618072 | 2618869 | 798 | pir: E70761 | *Mycobacterium tuberculosis* H37Rv Rv1544 | 40.0 | 57.0 | 258 | ketoacyl reductase |
| 2715 | 6215 | 2618882 | 2619538 | 657 | sp: ORN_ECOLI | *Escherichia coli* K12 orn | 48.0 | 78.8 | 179 | oligoribonuclease |
| 2716 | 6216 | 2620728 | 2619541 | 1188 | prf: 2409378A | *Salmonella enterica* iroD | 26.0 | 50.9 | 454 | ferric enterochelin esterase |
| 2717 | 6217 | 2622181 | 2620973 | 1209 | pir: C70870 | *Mycobacterium tuberculosis* H37Rv Rv2518c lppS | 48.5 | 71.9 | 398 | lipoprotein |
| 2718 | 6218 | 2622961 | 2623605 | 645 | | | | | | |
| 2719 | 6219 | 2623770 | 2623621 | 150 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2720 | 6220 | 2623803 | 2624048 | 246 | | | | | | |
| 2721 | 6221 | 2625358 | 2624051 | 1308 | gp: SCU53587_1 | *Corynebacterium glutamicum* ATCC 21086 | 99.5 | 99.8 | 436 | transposase (IS1207) |
| 2722 | 6222 | 2625600 | 2625806 | 207 | | | | | | |
| 2723 | 6223 | 2626447 | 2625809 | 639 | | | | | | |
| 2724 | 6224 | 2627924 | 2628376 | 453 | gp: AF085239_1 | *Salmonella typhimurium* KP1001 cytR | 32.8 | 63.4 | 131 | transcriptional regulator |
| 2725 | 6225 | 2628121 | 2626493 | 1629 | sp: GLSK_RAT | *Rattus norvegicus* SPRAGUE-DAWLEY KIDNEY | 35.2 | 69.3 | 358 | glutaminase |
| 2726 | 6226 | 2628376 | 2628852 | 477 | pir: A36940 | *Bacillus subtilis* 168 degA | 42.3 | 72.2 | 97 | sporulation-specific degradation regulator protein |
| 2727 | 6227 | 2628878 | 2628324 | 555 | | | | | | |
| 2728 | 6228 | 2628926 | 2630479 | 1554 | sp: UXAC_ECOLI | *Escherichia coli* K12 uxaC | 29.0 | 60.9 | 335 | uronate isomerase |
| 2729 | 6229 | 2630636 | 2631136 | 501 | | | | | | |
| 2730 | 6230 | 2631270 | 2632466 | 1197 | prf: 1814452C | *Zea diploperennis* perennial teosinte | 32.0 | 45.0 | 291 | hypothetical protein |
| 2731 | 6231 | 2632543 | 2633100 | 558 | prf: 2324444A | *Mycobacterium avium* pncA | 48.1 | 74.6 | 185 | pyrazinamidase/nicotinamidase |
| 2732 | 6232 | 2633418 | 2633146 | 273 | pir: E70870 | *Mycobacterium tuberculosis* H37Rv Rv2520c | 42.7 | 80.0 | 75 | hypothetical protein |
| 2733 | 6233 | 2633600 | 2634064 | 465 | sp: BCP_ECOLI | *Escherichia coli* K12 bcp | 46.8 | 73.8 | 141 | bacterioferritin comigratory protein |
| 2734 | 6234 | 2634116 | 2634751 | 636 | sp: SCI1_1 | *Streptomyces coelicolor* A3(2) SCI1.01c | 32.5 | 61.4 | 114 | bacterial regulatory protein, tetR family |
| 2735 | 6235 | 2635151 | 2634747 | 405 | gp: BAY15081_1 | *Corynebacterium ammoniagenes* ATCC 6871 ppt1 | 56.6 | 75.9 | 145 | phosphopantetheine protein transferase |
| 2736 | 6236 | 2636589 | 2635165 | 1425 | sp: AF237667_1 | *Corynebacterium glutamicum* lmrB | 52.4 | 85.6 | 473 | lincomycin resistance protein |
| 2737 | 6237 | 2636845 | 2637168 | 324 | pir: S76537 | *Synechocystis* sp. PCC6803 | 30.1 | 54.0 | 113 | hypothetical membrane protein |
| 2738 | 6238 | 2637653 | 2637240 | 414 | | | | | | |
| 2739 | 6239 | 2647627 | 2638649 | 8979 | pir: S2047 | *Corynebacterium ammoniagenes* fas | 62.3 | 83.6 | 3029 | fatty-acid synthase |
| 2740 | 6240 | 2649416 | 2648235 | 1182 | gp: SC4A7_14 | *Streptomyces coelicolor* A3(2) SC4A7.14 | 25.3 | 55.2 | 404 | hypothetical protein |
| 2741 | 6241 | 2649550 | 2650164 | 615 | pir: D70716 | *Mycobacterium tuberculosis* H37Rv Rv0950c | 40.4 | 60.9 | 230 | peptidase |
| 2742 | 6242 | 2650441 | 2650902 | 462 | sp: Y077_MYCT | *Mycobacterium tuberculosis* H37Rv Rv1343c | 40.2 | 67.9 | 112 | hypothetical membrane protein |
| 2743 | 6243 | 2650986 | 2651339 | 354 | sp: Y076_MYCLE | *Mycobacterium leprae* B1549_F2_59 | 37.2 | 69.0 | 113 | hypothetical membrane protein |
| 2744 | 6244 | 2652037 | 2651420 | 618 | sp: Y03Q_MYCTU | *Mycobacterium tuberculosis* H37Rv Rv1341 | 55.0 | 76.7 | 202 | hypothetical protein |
| 2745 | 6245 | 2652801 | 2652067 | 735 | sp: RNPH_PSEAE | *Pseudomonas aeruginosa* ATCC 15692 rph | 60.2 | 81.4 | 236 | ribonuclease PH |
| 2746 | 6246 | 2653254 | 2653009 | 246 | | | | | | |
| 2747 | 6247 | 2654018 | 2653326 | 693 | | | | | | |
| 2748 | 6248 | 2654660 | 2654079 | 582 | | | | | | |
| 2749 | 6249 | 2656236 | 2654875 | 1362 | sp: Y029_MYCTU | *Mycobacterium tuberculosis* H37Rv SC8A6.09c | 29.0 | 58.2 | 428 | hypothetical membrane protein |
| 2750 | 6250 | 2656452 | 2656985 | 534 | gp: AF121000_8 | *Corynebacterium glutamicum* 22243 R-plasmid pAG1 tnpB | 92.1 | 97.2 | 175 | transposase (IS1628) |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2751 | 6251 | 2657633 | 2656974 | 660 | sp: YO3O_MYCLE | Mycobacterium leprae ats | 46.0 | 74.4 | 250 | arylsulfatase |
| 2752 | 6252 | 2658500 | 2657736 | 765 | prf: 2516259A | Corynebacterium glutamicum ATCC 13869 murI | 99.3 | 99.3 | 284 | D-glutamate racemase |
| 2753 | 6253 | 2659457 | 2658606 | 852 | | | | | | |
| 2754 | 6254 | 2659496 | 2660131 | 636 | gp: SCE22_22 | Streptomyces coelicolor A3(2) SCE22.22 | 44.2 | 70.8 | 147 | bacterial regulatory protein, marR family |
| 2755 | 6255 | 2660638 | 2660147 | 492 | | | | | | |
| 2756 | 6256 | 2661417 | 2660671 | 747 | sp: YO3M_MYCTU | Mycobacterium tuberculosis H37Rv Rv1337 | 38.2 | 69.3 | 225 | hypothetical membrane protein |
| 2757 | 6257 | 2661565 | 2662455 | 891 | pir: A47039 | Flavobacterium sp. nylC | 30.2 | 58.3 | 321 | endo-type 6-aminohexanoate oligomer hydrolase |
| 2758 | 6258 | 2662376 | 2661417 | 960 | | | | | | |
| 2759 | 6259 | 2662867 | 2662331 | 537 | sp: YO3H_MYCTU | Mycobacterium tuberculosis H37Rv Rv1332 | 35.0 | 58.5 | 200 | hypothetical protein |
| 2760 | 6260 | 2663182 | 2662883 | 300 | sp: YO3G_MYCTU | Mycobacterium tuberculosis H37Rv Rv1331 | 57.1 | 77.1 | 105 | hypothetical protein |
| 2761 | 6261 | 2663437 | 2664060 | 624 | sp: YO3F_MYCTU | Mycobacterium tuberculosis H37Rv Rv1330c | 61.2 | 80.8 | 428 | hypothetical protein |
| 2762 | 6262 | 2664060 | 2665397 | 1338 | | | | | | |
| 2763 | 6263 | 2665687 | 2665992 | 306 | prf: 1816252A | Escherichia coli dinG | 25.2 | 53.3 | 647 | ATP-dependent helicase |
| 2764 | 6264 | 2666115 | 2667854 | 1740 | sp: YOA8_MYCTU | Mycobacterium tuberculosis H37Rv Rv2560 | 29.7 | 60.1 | 313 | hypothetical membrane protein |
| 2765 | 6265 | 2668760 | 2667870 | 891 | | | | | | |
| 2766 | 6266 | 2669561 | 2668839 | 723 | pir: T34684 | Streptomyces coelicolor A3(2) SC1B5.06c | 39.0 | 52.0 | 222 | hypothetical protein |
| 2767 | 6267 | 2670573 | 2669557 | 1017 | sp: SERB_ECOLI | Escherichia coli K12 serB | 38.7 | 61.0 | 310 | phosphoserine phosphatase |
| 2768 | 6268 | 2671126 | 2672721 | 1596 | | | | | | |
| 2769 | 6269 | 2672805 | 2671063 | 1743 | pir: D45335 | Mycobacterium tuberculosis H37Rv Rv3043c | 46.8 | 74.4 | 575 | cytochrome c oxidase chain I |
| 2770 | 6270 | 2672950 | 2673255 | 306 | gp: AF112536_1 | Corynebacterium glutamicum ATCC 13032 nrdF | 99.7 | 99.7 | 334 | ribonucleotide reductase beta-chain |
| 2771 | 6271 | 2674339 | 2673338 | 1002 | | | | | | |
| 2772 | 6272 | 2674804 | 2675289 | 486 | sp: FTNA_ECOLI | Escherichia coli K12 ftnA | 31.5 | 64.2 | 159 | ferritin |
| 2773 | 6273 | 2675491 | 2676240 | 750 | gp: SCA32WHIH_4 | Streptomyces coelicolor A3(2) whiH | 32.8 | 60.2 | 256 | sporulation transcription factor |
| 2774 | 6274 | 2676902 | 2676243 | 660 | pir: I40339 | Corynebacterium glutamicum ATCC 13869 dtxR | 27.6 | 60.4 | 225 | iron dependent repressor or diptheria toxin repressor |
| 2775 | 6275 | 2676940 | 2677377 | 438 | sp: TIR2_YEAST | Saccharomyces cerevisiae YPH148 YOR010C TIR2 | 24.2 | 62.1 | 124 | cold shock protein TIR2 precursor |
| 2776 | 6276 | 2677193 | 2676918 | 276 | pir: C69281 | Archaeoglobus fulgidus AF0251 | 50.0 | 86.0 | 50 | hypothetical membrane protein |
| 2777 | 6277 | 2679598 | 2677478 | 2121 | gp: AF112535_3 | Corynebacterium glutamicum ATCC 13032 nrdE | 99.9 | 100.0 | 707 | ribonucleotide reductase alpha-chain |
| 2778 | 6278 | 2680470 | 2680784 | 315 | | | | | | |
| 2779 | 6279 | 2681363 | 2681223 | 141 | SP: RL36_RICPR | Rickettsia prowazekii | 58.0 | 79.0 | 41 | 50S ribosomal protein L36 |
| 2780 | 6280 | 2681546 | 2682376 | 831 | sp: NADE_BACSU | Bacillus subtilis 168 nadE | 55.6 | 78.1 | 279 | NH3-dependent NAD(+) synthetase |
| 2781 | 6281 | 2681556 | 2681464 | 93 | | | | | | |
| 2782 | 6282 | 2683119 | 2683616 | 498 | | | | | | |
| 2783 | 6283 | 2683125 | 2682379 | 747 | pir: S76790 | Synechocystis sp. PCC6803 str1563 | 30.7 | 56.4 | 257 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2784 | 6284 | 2683418 | 2683131 | 288 | pir: G70922 | *Mycobacterium tuberculosis* H37Rv Rv3129 | 41.7 | 68.8 | 96 | hypothetical protein |
| 2785 | 6285 | 2684646 | 2683627 | 1020 | sp: ADH2_BACST | *Bacillus stearothermophilus* DSM 2334 adh | 26.1 | 52.8 | 337 | alcohol dehydrogenase |
| 2786 | 6286 | 2684919 | 2686289 | 1371 | sp: MMGE_BACSU | *Bacillus subtilis* 168 mmgE | 27.0 | 56.0 | 459 | *Bacillus subtilis* mmg (for mother cell metabolic genes) |
| 2787 | 6287 | 2686315 | 2687148 | 834 | pir: T05174 | *Arabidopsis thaliana* T6K22.50 | 33.8 | 66.2 | 284 | hypothetical protein |
| 2788 | 6288 | 2688240 | 2687449 | 792 | sp: PGMU_ECOLI | *Escherichia coli* K12 pgm | 61.7 | 80.6 | 556 | phosphoglucomutase |
| 2789 | 6289 | 2690050 | 2688389 | 1662 | pir: F70650 | *Mycobacterium tuberculosis* H37Rv Rv3069 | 41.7 | 64.3 | 84 | hypothetical membrane protein |
| 2790 | 6290 | 2690150 | 2690437 | 288 | | | | | | |
| 2791 | 6291 | 2690437 | 2690760 | 324 | pir: D71843 | *Helicobacter pylori* J99 Jhp1146 | 25.4 | 61.5 | 122 | hypothetical membrane protein |
| 2792 | 6292 | 2690773 | 2691564 | 792 | sp: YCSL_BACSU | *Bacillus subtilis* 168 ycsI | 51.2 | 79.1 | 254 | hypothetical protein |
| 2793 | 6293 | 2691689 | 2693053 | 1365 | gp: AF126281_1 | *Rhodococcus erythropolis* | 24.2 | 48.6 | 496 | transposase (IS1676) |
| 2794 | 6294 | 2693299 | 2694918 | 1620 | sp: CSP1_CORGL | *Corynebacterium glutamicum* (*Brevibacterium flavum*) ATCC 17965 csp1 | 24.8 | 49.6 | 355 | major secreted protein PS1 protein precursor |
| 2795 | 6295 | 2694926 | 2695279 | 354 | | | | | | |
| 2796 | 6296 | 2695554 | 2695718 | 165 | | | | | | |
| 2797 | 6297 | 2695766 | 2695320 | 447 | | | | | | |
| 2798 | 6298 | 2695812 | 2697212 | 1401 | gp: AF126281_1 | *Rhodococcus erythropolis* | 24.6 | 46.6 | 500 | transposase (IS1676) |
| 2799 | 6299 | 2698150 | 2697383 | 768 | sp: GLTT_BACCA | *Bacillus subtilis* 168 | 30.8 | 66.2 | 438 | proton/sodium-glutamate symport protein |
| 2800 | 6300 | 2699531 | 2698194 | 1338 | | | | | | |
| 2801 | 6301 | 2700920 | 2701612 | 693 | gp: SCE25_30 | *Streptomyces coelicolor* A3(2) SCE25.30 | 33.0 | 69.0 | 873 | ABC transporter |
| 2802 | 6302 | 2702466 | 2699926 | 2541 | | | | | | |
| 2803 | 6303 | 2702466 | 2703356 | 891 | gp: SAU18641_2 | *Staphylococcus aureus* | 45.4 | 79.8 | 218 | ABC transporter ATP-binding protein |
| 2804 | 6304 | 2703194 | 2702487 | 708 | PIR: F81516 | *Chlamydophila pneumoniae* AR39 CP0987 | 60.0 | 67.0 | 84 | hypothetical protein |
| 2805 | 6305 | 2704314 | 2704586 | 273 | | | | | | |
| 2806 | 6306 | 2704835 | 2704975 | 141 | PIR: F81737 | *Chlamydia muridarum* Nigg TC0129 | 71.0 | 75.0 | 42 | hypothetical protein |
| 2807 | 6307 | 2709878 | 2710555 | 678 | | | | | | |
| 2808 | 6308 | 2710637 | 2711308 | 672 | prf: 2509388L | *Streptomyces collinus* Tu 1892 ansG | 28.1 | 54.1 | 196 | oxidoreductase or dehydrogenase |
| 2809 | 6309 | 2711850 | 2712374 | 525 | sp: Y089_MYCTU | *Mycobacterium tuberculosis* H37Rv Rv0089 | 25.9 | 51.2 | 205 | methyltransferase |
| 2810 | 6310 | 2713181 | 2713453 | 273 | GSP: Y35814 | *Chlamydia pneumoniae* | 61.0 | 66.0 | 84 | hypothetical protein |
| 2811 | 6311 | 2713702 | 2713842 | 141 | PIR: F81737 | *Chlamydia muridarum* Nigg TC0129 | 71.0 | 75.0 | 42 | hypothetical protein |
| 2812 | 6312 | 2718187 | 2717993 | 195 | | | | | | |
| 2813 | 6313 | 2719689 | 2718436 | 1254 | sp: MURA_ACICA | *Acinetobacter calcoaceticus* NCIB 8250 murA | 44.8 | 75.3 | 417 | UDP-N-acetylglucosamine 1-carboxyvinyltransferase |
| 2814 | 6314 | 2719750 | 2720319 | 570 | sp: Y02Y_MYCTU | *Mycobacterium tuberculosis* H37Rv Rv1314c | 66.3 | 84.2 | 190 | hypothetical protein |
| 2815 | 6315 | 2721227 | 2720385 | 843 | gp: SC2G5_15 | *Streptomyces coelicolor* A3(2) SC2G5.15c | 45.9 | 69.0 | 281 | transcriptional regulator |
| 2816 | 6316 | 2721702 | 2721295 | 408 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2817 | 6317 | 2721934 | 2722857 | 924 | sp: CYSK_BACSU | *Bacillus subtilis* 168 cysK | 57.1 | 84.6 | 305 | cysteine synthase |
| 2818 | 6318 | 2723064 | 2723609 | 546 | prf: 2417357C | *Azotobacter vinelandii* cysE2 | 61.1 | 79.7 | 172 | O-acetylserine synthase |
| 2819 | 6319 | 2724057 | 2723770 | 288 | gp: AE002024_10 | *Deinococcus radiodurans* R1 DR1844 | 36.1 | 65.1 | 83 | hypothetical protein |
| 2820 | 6320 | 2725359 | 2724478 | 882 | sp: SUCD_COXBU | *Coxiella burnetii* Nine Mile Ph I sucD | 52.9 | 79.4 | 291 | succinyl-CoA synthetase alpha chain |
| 2821 | 6321 | 2725619 | 2725843 | 225 | PIR: F72706 | *Aeropyrum pernix* K1 APE1069 | 42.0 | 43.0 | 75 | hypothetical protein |
| 2822 | 6322 | 2726577 | 2725384 | 1194 | sp: SUCC_BACSU | *Bacillus subtilis* 168 sucC | 39.8 | 73.0 | 400 | succinyl-CoA synthetase beta chain |
| 2823 | 6323 | 2727145 | 2726786 | 360 | | | | | | |
| 2824 | 6324 | 2728133 | 2727399 | 735 | gp: AF058302_5 | *Streptomyces roseofulvus* frnE | 38.5 | 71.8 | 213 | frenolicin gene E product |
| 2825 | 6325 | 2729025 | 2728207 | 819 | | | | | | |
| 2826 | 6326 | 2730916 | 2729378 | 1539 | sp: CAT1_CLOKL | *Clostridium kluyveri* cat1 cat1 | 47.9 | 77.8 | 501 | succinyl-CoA coenzyme A transferase |
| 2827 | 6327 | 2731376 | 2732518 | 1143 | sp: NIR3_AZOBR | *Azospirillum brasilense* ATCC 29145 ntrC | 38.6 | 68.5 | 321 | transcriptional regulator |
| 2828 | 6328 | 2732230 | 2731424 | 807 | | | | | | |
| 2829 | 6329 | 2732636 | 2733367 | 732 | pir: E70810 | *Mycobacterium tuberculosis* H37Rv Rv0821c phoY-2 | 46.5 | 81.7 | 213 | phosphate transport system regulatory protein |
| 2830 | 6330 | 2734351 | 2733455 | 897 | pir: S68595 | *Pseudomonas aeruginosa* pstB | 58.8 | 82.8 | 255 | phosphate-specific transport component |
| 2831 | 6331 | 2735184 | 2734264 | 921 | gp: MTPSTA1_1 | *Mycobacterium tuberculosis* H37Rv Rv0830 pstA1 | 51.4 | 82.2 | 292 | phosphate ABC transport system permease protein |
| 2832 | 6332 | 2736215 | 2735202 | 1014 | pir: A70584 | *Mycobacterium tuberculosis* H37Rv Rv0829 pstC2 | 50.2 | 78.5 | 325 | phosphate ABC transport system permease protein |
| 2833 | 6333 | 2737538 | 2736414 | 1125 | pir: H70583 | *Mycobacterium tuberculosis* H37Rv phoS2 | 40.0 | 56.0 | 369 | phosphate-binding protein S-3 precursor |
| 2834 | 6334 | 2738711 | 2737836 | 876 | gp: SCD84_18 | *Streptomyces coelicolor* A3(2) SCD84.18c | 34.3 | 60.0 | 315 | acetyltransferase |
| 2835 | 6335 | 2738771 | 2739553 | 783 | | | | | | |
| 2836 | 6336 | 2740650 | 2739556 | 1095 | sp: BMRU_BACSU | *Bacillus subtilis* 168 bmrU | 24.7 | 55.2 | 344 | hypothetical protein |
| 2837 | 6337 | 2740670 | 2741356 | 687 | pir: E70809 | *Mycobacterium tuberculosis* H37Rv Rv0813c | 44.9 | 74.2 | 225 | hypothetical protein |
| 2838 | 6338 | 2742577 | 2741636 | 942 | gp: AF193846_1 | *Solanum tuberosum* BCAT2 | 28.6 | 56.0 | 259 | branched-chain amino acid aminotransferase |
| 2839 | 6339 | 2742685 | 2743785 | 1101 | gp: AB003158_6 | *Corynebacterium ammoniagenes* ATCC 6872 ORF4 | 58.5 | 79.0 | 352 | hypothetical protein |
| 2840 | 6340 | 2744010 | 2744222 | 213 | pir: B70809 | *Mycobacterium tuberculosis* H37Rv Rv0810c | 58.6 | 81.0 | 58 | hypothetical protein |
| 2841 | 6341 | 2745954 | 2744881 | 1074 | gp: AB003158_5 | *Corynebacterium ammoniagenes* ATCC 6872 purM | 81.0 | 94.2 | 347 | 5'-phosphoribosyl-5-aminoimidazole synthetase |
| 2842 | 6342 | 2747564 | 2746083 | 1482 | gp: AB003158_4 | *Corynebacterium ammoniagenes* ATCC 6872 purF | 70.3 | 89.0 | 482 | amidophosphoribosyl transferase |
| 2843 | 6343 | 2748057 | 2747683 | 375 | pir: H70536 | *Mycobacterium tuberculosis* H37Rv Rv0807 | 57.3 | 75.8 | 124 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2844 | 6344 | 2748095 | 2749111 | 1017 | gp: AB003158_2 | Corynebacterium ammoniagenes ATCC 6872 ORF2 | 75.9 | 94.0 | 315 | hypothetical protein |
| 2845 | 6345 | 2749902 | 2749162 | 741 | gp: AB003158_1 | Corynebacterium ammoniagenes ATCC 6872 ORF1 | 67.7 | 87.1 | 217 | hypothetical membrane protein |
| 2846 | 6346 | 2751918 | 2752103 | 186 | GP: SSU18930_214 | Sulfolobus solfataricus | 64.0 | 71.0 | 42 | hypothetical protein |
| 2847 | 6347 | 2752312 | 2750027 | 2286 | gp: AB003162_3 | Corynebacterium ammoniagenes ATCC 6872 purL | 77.6 | 89.5 | 763 | 5'-phosphoribosyl-N-formylglycinamidine synthetase |
| 2848 | 6348 | 2752402 | 2753121 | 720 | | | | | | |
| 2849 | 6349 | 2752995 | 2752327 | 669 | gp: AB003162_2 | Corynebacterium ammoniagenes ATCC 6872 purQ | 80.3 | 93.3 | 223 | 5'-phosphoribosyl-N-formylglycinamidine synthetase |
| 2850 | 6350 | 2753237 | 2752995 | 243 | gp: AB003162_1 | Corynebacterium ammoniagenes ATCC 6872 purorf | 81.0 | 93.7 | 79 | hypothetical protein |
| 2851 | 6351 | 2753298 | 2753819 | 522 | | | | | | |
| 2852 | 6352 | 2753804 | 2753328 | 477 | prf: 2420329A | Lactococcus lactis gpo | 46.2 | 77.9 | 158 | gluthatione peroxidase |
| 2853 | 6353 | 2753992 | 2756739 | 2748 | prf: 2216389A | Aeromonas hydrophila JMP636 nucH | 28.0 | 51.5 | 965 | extracellular nuclease |
| 2854 | 6354 | 2756851 | 2757126 | 276 | | | | | | |
| 2855 | 6355 | 2757815 | 2757129 | 687 | pir: C70709 | Mycobacterium tuberculosis H37Rv Rv0784 | 37.4 | 68.7 | 211 | hypothetical protein |
| 2856 | 6356 | 2759200 | 2757863 | 1338 | sp: DCTA_SALTY | Salmonella typhimurium LT2 dctA | 49.0 | 81.6 | 414 | C4-dicarboxylate transporter |
| 2857 | 6357 | 2761649 | 2759532 | 2118 | prf: 2408266A | Pseudomonas sp. WO24 dapb1 | 41.8 | 70.6 | 697 | dipetidyl aminopeptidase |
| 2858 | 6358 | 2762452 | 2761829 | 624 | | | | | | |
| 2859 | 6359 | 2762675 | 2761785 | 891 | gp: AB003161_3 | Corynebacterium ammoniagenes ATCC 6872 purC | 70.1 | 89.1 | 294 | 5'-phosphoribosyl-4-N-succinocarboxamide-5-amino imidazole synthetase |
| 2860 | 6360 | 2764931 | 2763504 | 1428 | gp: AB003161_2 | Corynebacterium ammoniagenes ATCC 6872 purB | 85.3 | 95.0 | 477 | adenylosuccino lyase |
| 2861 | 6361 | 2766135 | 2764978 | 1158 | sp: AAT_SULSO | Sulfolobus solfataricus ATCC 49255 | 28.1 | 62.3 | 395 | aspartate aminotransferase |
| 2862 | 6362 | 2767420 | 2766158 | 1263 | gp: AB003161_1 | Corynebacterium ammoniagenes ATCC 6872 purD | 71.1 | 86.4 | 425 | 5'-phosphoribosylglycinamide synthetase |
| 2863 | 6363 | 2767580 | 2767993 | 414 | sp: YHIT_MYCLE | Mycobacterium leprae u296a | 53.7 | 80.2 | 136 | histidine triad (HIT) family protein |
| 2864 | 6364 | 2768137 | 2767703 | 435 | | | | | | |
| 2865 | 6365 | 2769095 | 2768343 | 753 | pir: S62195 | Methanosarcina barkeri orf3 | 26.8 | 56.4 | 243 | hypothetical protein |
| 2866 | 6366 | 2770511 | 2769156 | 1356 | sp: DTPT_LACLA | Lactococcus lactis subsp. lactis dipT | 30.1 | 67.6 | 469 | di-/tripeptide transpoter |
| 2867 | 6367 | 2770714 | 2771982 | 1269 | sp: BIOA_CORGL | Corynebacterium glutamicum (Brevibacterium flavum) MJ233 bioA | 95.7 | 98.8 | 423 | adenosylmethionine-8-amino-7-oxononanoate aminotransferase or 7,8-diaminopelargonic acid aminotransferase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2868 | 6368 | 2771989 | 2772660 | 672 | sp: BIOD_CORGL | *Corynebacterium glutamicum* (*Brevibacterium flavum*) MJ233 bioD | 98.7 | 99.6 | 224 | dethiobiotin synthetase |
| 2869 | 6369 | 2774098 | 2772644 | 1455 | gp: AF049873_3 | *Lactococcus lactis* M71plasmid pND306 | 31.3 | 70.5 | 335 | two-component system sensor histidine kinase |
| 2870 | 6370 | 2774814 | 2774110 | 705 | prf: 2222216A | *Thermotoga maritima* drrA | 42.0 | 72.7 | 231 | two-component system regulatory protein |
| 2871 | 6371 | 2775689 | 2774937 | 753 | sp: TIPA_STRLI | *Streptomyces lividans* tipA | 37.4 | 69.5 | 249 | transcriptional activator |
| 2872 | 6372 | 2776879 | 2775740 | 1140 | prf: 2419350A | *Arthrobacter* sp. DK-38 | 30.9 | 53.9 | 382 | metal-activated pyridoxal enzyme or low specificity D-Thr aldolase |
| 2873 | 6373 | 2778504 | 2776768 | 1737 | gp: ECOPOXB8G_1 | *Escherichia coli* K12 poxB | 46.3 | 75.8 | 574 | pyruvate oxidase |
| 2874 | 6374 | 2778965 | 2780446 | 1482 | prf: 2212334B | *Staphylococcus aureus* plasmid pSK23 qacB | 33.3 | 68.9 | 504 | multidrug efflux protein |
| 2875 | 6375 | 2780439 | 2780969 | 531 | sp: YCDC_ECOLI | *Escherichia coli* K12 ycdC | 30.4 | 68.5 | 92 | transcriptional regulator |
| 2876 | 6376 | 2780996 | 2782315 | 1320 | pir: D70551 | *Mycobacterium tuberculosis* H37Rv Rv2508c | 45.6 | 78.4 | 421 | hypothetical membrane protein |
| 2877 | 6377 | 2784481 | 2782340 | 2142 | | | | | | |
| 2878 | 6378 | 2785615 | 2784656 | 960 | gp: AF096929_2 | *Rhodococcus erythropolis* SQ1 kstD1 | 34.3 | 62.1 | 303 | 3-ketosteroid dehydrogenase |
| 2879 | 6379 | 2786355 | 2785651 | 705 | sp: ALSR_BACSU | *Bacillus subtilis* 168 alsR | 37.1 | 69.0 | 232 | transcriptional regulator, LysR family |
| 2880 | 6380 | 2787782 | 2788594 | 813 | pir: C70982 | *Mycobacterium tuberculosis* H37Rv Rv3298c lpqC | 28.4 | 52.9 | 278 | hypothetical protein |
| 2881 | 6381 | 2789399 | 2788587 | 813 | pir: C69862 | *Bacillus subtilis* 168 ykrA | 26.7 | 55.6 | 288 | hypothetical protein |
| 2882 | 6382 | 2789935 | 2789477 | 459 | | | | | | |
| 2883 | 6383 | 2790152 | 2790550 | 399 | pir: A45264 | *Oryctolagus cuniculus* kidney cortex rBAT | 28.6 | 50.7 | 140 | hypothetical protein |
| 2884 | 6384 | 2790946 | 2792448 | 1503 | pir: B70798 | *Mycobacterium tuberculosis* H37Rv Rv3737 | 36.0 | 64.0 | 464 | hypothetical membrane protein |
| 2885 | 6385 | 2792531 | 2792857 | 327 | pir: S41307 | *Streptomyces griseus* hrdB | 32.3 | 50.3 | 155 | transcription initiation factor sigma |
| 2886 | 6386 | 2792873 | 2794327 | 1455 | sp: TPS1_SCHPO | *Schizosaccharomyces pombe* tps1 | 38.8 | 66.7 | 487 | trehalose-6-phosphate synthase |
| 2887 | 6387 | 2794300 | 2794812 | 513 | | | | | | |
| 2888 | 6388 | 2794870 | 2795637 | 768 | sp: OTSB_ECOLI | *Escherichia coli* K12 otsB | 27.4 | 57.6 | 245 | trehalose-phosphatase |
| 2889 | 6389 | 2796749 | 2795676 | 1074 | sp: CCPA_BACME | *Bacillus megaterium* ccpA | 24.7 | 60.2 | 344 | glucose-resistance amylase regulator |
| 2890 | 6390 | 2796865 | 2797806 | 942 | sp: ZNUA_HAEIN | *Haemophilus influenzae* Rd HI0119 znuA | 22.4 | 46.7 | 353 | high-affinity zinc uptake system protein |
| 2891 | 6391 | 2797820 | 2798509 | 690 | gp: AF121672_2 | *Staphylococcus aureus* 8325-4 mreA | 31.4 | 63.2 | 223 | ABC transporter |
| 2892 | 6392 | 2798837 | 2799391 | 555 | pir: E70507 | *Mycobacterium tuberculosis* H37Rv Rv2060 | 60.0 | 87.4 | 135 | hypothetical membrane protein |
| 2893 | 6393 | 2799535 | 2801034 | 1500 | pir: A69426 | *Archaeoglobus fulgidus* | 23.4 | 52.5 | 303 | transposase (ISA0963-5) |
| 2894 | 6394 | 2801113 | 2801313 | 201 | | | | | | |
| 2895 | 6395 | 2803246 | 2801558 | 1689 | gp: AF096929_2 | *Rhodococcus erythropolis* SQ1 kstD1 | 32.1 | 62.0 | 561 | 3-ketosteroid dehydrogenase |
| 2896 | 6396 | 2803996 | 2803250 | 747 | | | | | | |
| 2897 | 6397 | 2804691 | 2804074 | 618 | pir: B72359 | *Thermotoga maritima* MSB8 bplA | 34.3 | 56.4 | 204 | lipopolysaccharide biosynthesis protein or oxidoreductase or dehydrogenase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2898 | 6398 | 2805110 | 2804676 | 435 | sp: MI2D_BACSU | *Bacillus subtilis* 168 idh or iolG | 35.2 | 69.5 | 128 | dehydrogenase or myo-inositol 2-dehydrogenase |
| 2899 | 6399 | 2805967 | 2805113 | 855 | sp: SHIA_ECOLI | *Escherichia coli* K12 shiA | 30.5 | 67.5 | 292 | shikimate transport protein |
| 2900 | 6400 | 2806441 | 2806016 | 426 | sp: SHIA_ECOLI | *Escherichia coli* K12 shiA | 43.1 | 80.8 | 130 | shikimate transport protein |
| 2901 | 6401 | 2807252 | 2806599 | 654 | gp: SC5A7_19 | *Streptomyces coelicolor* A3(2) SC5A7.19c | 32.6 | 55.7 | 212 | transcriptional regulator |
| 2902 | 6402 | 2808364 | 2807426 | 939 | sp: PT56_YEAST | *Saccharomyces cerevisiae* YOR201C PET56 | 22.8 | 47.3 | 334 | ribosomal RNA ribose methylase or tRNA/rRNA methyltransferase |
| 2903 | 6403 | 2809778 | 2808399 | 1380 | sp: SYC_ECOLI | *Escherichia coli* K12 cysS | 42.2 | 68.8 | 464 | cysteinyl-tRNA synthetase |
| 2904 | 6404 | 2811806 | 2809824 | 1983 | prf: 2511335C | *Lactococcus lactis* sacB | 47.0 | 77.0 | 668 | PTS system, enzyme II sucrose protein (sucrose-specific IIABC component) |
| 2905 | 6405 | 2813258 | 2811960 | 1299 | gp: AF205034_4 | *Clostridium acetobutylicum* ATCC 824 scrB | 35.3 | 56.9 | 473 | sucrose 6-phosphate hydrolase or sucrase |
| 2906 | 6406 | 2814037 | 2813279 | 759 | sp: NAGB_ECOLI | *Escherichia coli* K12 nagB | 38.3 | 69.4 | 248 | glucosamine-6-phosphate isomerase |
| 2907 | 6407 | 2815232 | 2814081 | 1152 | sp: NAGA_VIBFU | *Vibrio furnissii* SR1514 manD | 30.2 | 60.3 | 368 | N-acetylglucosamine-6-phosphate deacetylase |
| 2908 | 6408 | 2815458 | 2816393 | 936 | sp: DAPA_ECOLI | *Escherichia coli* K12 dapA | 28.2 | 62.1 | 298 | dihydrodipicolinate synthase |
| 2909 | 6409 | 2816409 | 2817317 | 909 | sp: GLK_STRCO | *Streptomyces coelicolor* A3(2) SC6E10.20c glk | 28.7 | 57.6 | 321 | glucokinase |
| 2910 | 6410 | 2817363 | 2818058 | 696 | prf: 2516292A | *Clostridium perfringens* NCTC 8798 nanE | 36.4 | 68.6 | 220 | N-acetylmannosamine-6-phosphate epimerase |
| 2911 | 6411 | 2818313 | 2818137 | 177 | sp: NANH_MICVI | *Micromonospora viridifaciens* ATCC 31146 nadA | 24.8 | 50.3 | 439 | sialidase precursor |
| 2912 | 6412 | 2819564 | 2818350 | 1215 | | | | | | |
| 2913 | 6413 | 2820285 | 2819557 | 729 | gp: AF181498_1 | *Rhizobium etli* ansR | 26.6 | 57.2 | 222 | L-asparagine permease operon repressor |
| 2914 | 6414 | 2820584 | 2822191 | 1608 | gp: BFU64514_1 | *Bacillus firmus* OF4 dppA | 22.5 | 51.4 | 560 | dipeptide transporter protein or heme-binding protein |
| 2915 | 6415 | 2822387 | 2823337 | 951 | sp: DPPB_BACFI | *Bacillus firmus* OF4 dappB | 31.9 | 64.3 | 342 | dipeptide transport system permease protein |
| 2916 | 6416 | 2824274 | 2825341 | 1068 | sp: OPPD_BACSU | *Bacillus subtilis* 168 oppD | 46.5 | 78.3 | 314 | oligopeptide transport ATP-binding protein |
| 2917 | 6417 | 2825341 | 2826156 | 816 | sp: OPPF_LACLA | *Lactococcus lactis* oppF | 43.4 | 78.7 | 258 | oligopeptide transport ATP-binding protein |
| 2918 | 6418 | 2826835 | 2826215 | 621 | sp: RHTB_ECOLI | *Escherichia coli* K12 rhtB | 28.5 | 62.7 | 193 | homoserine/homoserin lactone efflux protein or lysE type translocator |
| 2919 | 6419 | 2826922 | 2827404 | 483 | prf: 2309303A | *Bradyrhizobium japonicum* lrp | 31.0 | 66.2 | 142 | leucine-responsive regulatory protein |
| 2920 | 6420 | 2827817 | 2827458 | 360 | pir: C70607 | *Mycobacterium tuberculosis* H37Rv Rv3581c | 55.9 | 86.2 | 152 | hypothetical protein |
| 2921 | 6421 | 2828383 | 2827904 | 480 | pir: C70607 | *Mycobacterium tuberculosis* H37Rv Rv3581c | 55.9 | 86.2 | 152 | hypothetical protein |
| 2922 | 6422 | 2829146 | 2828379 | 768 | sp: Y18T_MYCTU | *Mycobacterium tuberculosis* H37Rv Rv3582c | 46.4 | 71.5 | 235 | hypothetical protein |
| 2923 | 6423 | 2829749 | 2829156 | 594 | pir: H70803 | *Mycobacterium tuberculosis* H37Rv Rv3583c | 73.3 | 91.1 | 157 | transcription factor |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2924 | 6424 | 2830057 | 2830779 | 723 | prf: 2214304A | *Mycobacterium tuberculosis* H37Rv Rv3246c mtrA | 43.5 | 70.0 | 223 | two-component system response regulator |
| 2925 | 6425 | 2830779 | 2831894 | 1116 | sp: BAES_ECOLI | *Escherichia coli* K12 baeS | 29.3 | 67.7 | 341 | two-component system sensor histidine kinase |
| 2926 | 6426 | 2832085 | 2832666 | 582 | sp: RADA_ECOLI | *Escherichia coli* K12 radA | 41.5 | 74.3 | 463 | DNA repair protein RadA |
| 2927 | 6427 | 2832790 | 2834181 | 1392 | sp: YACK_BACSU | *Bacillus subtilis* 168 yacK | 40.3 | 73.3 | 345 | hypothetical protein |
| 2928 | 6428 | 2834188 | 2835285 | 1098 | pir: D70804 | *Mycobacterium tuberculosis* H37Rv Rv3587c | 29.4 | 53.3 | 231 | hypothetical protein |
| 2929 | 6429 | 2835969 | 2835283 | 687 | | | | | | |
| 2930 | 6430 | 2837499 | 2836048 | 1452 | gp: PPU96338_1 | *Pseudomonas putida* NCIMB 9866 plasmid pRA4000 | 59.5 | 85.1 | 471 | p-hydroxybenzaldehyde dehydrogenase |
| 2931 | 6431 | 2837737 | 2837591 | 147 | pir: T08204 | *Chlamydomonas reinhardtii* ca1 | 36.7 | 66.2 | 210 | mitochondrial carbonate dehydratase beta |
| 2932 | 6432 | 2838576 | 2837956 | 621 | | | | | | |
| 2933 | 6433 | 2838643 | 2839521 | 879 | gp: AF121797_1 | *Streptomyces antibioticus* IMRU 3720 mutY | 48.4 | 70.7 | 283 | A/G-specific adenine glycosylase |
| 2934 | 6434 | 2839562 | 2840716 | 1155 | gp: AB009078_1 | *Brevibacterium saccharolyticum* | 99.2 | 99.6 | 258 | L-2,3-butanediol dehydrogenase |
| 2935 | 6435 | 2841063 | 2840758 | 306 | | | | | | |
| 2936 | 6436 | 2841075 | 2841848 | 774 | | | | | | |
| 2937 | 6437 | 2842130 | 2842453 | 324 | | | | | | |
| 2938 | 6438 | 2842493 | 2843233 | 741 | | | | | | |
| 2939 | 6439 | 2843405 | 2843716 | 312 | | | | | | |
| 2940 | 6440 | 2843722 | 2843432 | 291 | pir: E70552 | *Mycobacterium tuberculosis* H37Rv Rv3592 | 48.5 | 69.1 | 97 | hypothetical protein |
| 2941 | 6441 | 2845139 | 2845558 | 420 | GSP: Y29188 | *Pseudomonas aeruginosa* ORF24222 | 57.0 | 63.0 | 99 | virulence factor |
| 2942 | 6442 | 2845889 | 2846101 | 213 | GSP: Y29193 | *Pseudomonas aeruginosa* ORF25110 | 54.0 | 55.0 | 72 | virulence factor |
| 2943 | 6443 | 2846186 | 2846506 | 321 | GSP: Y29193 | *Pseudomonas aeruginosa* ORF25110 | 74.0 | 75.0 | 55 | virulence factor |
| 2944 | 6444 | 2846940 | 2844166 | 2775 | sp: MECB_BACSU | *Bacillus subtilis* 168 mecB | 58.5 | 86.2 | 832 | ClpC adenosine triphosphatase/ATP-binding proteinase |
| 2945 | 6445 | 2847229 | 2848659 | 1431 | gp: AB035643_1 | *Bacillus cereus* ts-4 impdh | 37.1 | 70.2 | 469 | inosine monophosphate dehydrogenase |
| 2946 | 6446 | 2848769 | 2849779 | 1011 | pir: JC6117 | *Rhodococcus rhodochrous* nitR | 24.7 | 62.7 | 316 | transcription factor |
| 2947 | 6447 | 2850031 | 2851815 | 1785 | sp: PH2M_TRICU | *Trichosporon cutaneum* ATCC 46490 | 33.5 | 60.9 | 680 | phenol 2-monooxygenase |
| 2948 | 6448 | 2852017 | 2853732 | 1716 | | | | | | |
| 2949 | 6449 | 2853769 | 2855709 | 1941 | | | | | | |
| 2950 | 6450 | 2855795 | 2857516 | 1722 | | | | | | |
| 2951 | 6451 | 2859044 | 2859205 | 162 | | | | | | |
| 2952 | 6452 | 2859055 | 2857613 | 1443 | gp: AF237667_1 | *Corynebacterium glutamicum* lmrB | 100.0 | 100.0 | 481 | lincomycin resistance protein |
| 2953 | 6453 | 2860145 | 2859195 | 951 | pir: G70807 | *Mycobacterium tuberculosis* H37Rv Rv3517 | 26.7 | 55.8 | 240 | hypothetical protein |
| 2954 | 6454 | 2862082 | 2860505 | 1578 | gp: AB012100_1 | *Bacillus stearothermophilus* lysS | 41.7 | 71.2 | 511 | lysyl-tRNA synthetase |
| 2955 | 6455 | 2862929 | 2862132 | 798 | gp: CGPAN_2 | *Corynebacterium glutamicum* ATCC 13032 panC | 29.9 | 52.6 | 268 | pantoate—beta-alanine ligase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2956 | 6456 | 2863621 | 2862929 | 693 | | | | | | |
| 2957 | 6457 | 2864421 | 2863624 | 798 | | | | | | |
| 2958 | 6458 | 2864848 | 2864384 | 465 | gp: MLCB2548_4 | *Mycobacterium leprae* MLCB2548.04c | 29.0 | 69.6 | 138 | hypothetical membrane protein |
| 2959 | 6459 | 2865343 | 2864867 | 477 | sp: HPPK_METEX | *Methylobacterium extorquens* AM1 folK | 42.4 | 69.0 | 158 | 2-amino-4-hydroxy-6-hydroxymethyldihydropteridine pyrophosphokinase |
| 2960 | 6460 | 2865735 | 2865346 | 390 | sp: FOLB_BACSU | *Bacillus subtilis* 168 folB | 38.1 | 69.5 | 118 | dihydroneopterin aldolase |
| 2961 | 6461 | 2866567 | 2865731 | 837 | gp: AB028656_1 | *Mycobacterium leprae* folP | 51.5 | 75.0 | 268 | dihydropteroate synthase |
| 2962 | 6462 | 2867173 | 2866586 | 588 | sp: GCH1_BACSU | *Bacillus subtilis* 168 mtrA | 60.6 | 86.2 | 188 | GTP cyclohydrolase I |
| 2963 | 6463 | 2867471 | 2868385 | 915 | | | | | | |
| 2964 | 6464 | 2869748 | 2867169 | 2580 | | | 56.0 | 69.0 | 782 | cell division protein FtsH |
| 2965 | 6465 | 2870444 | 2869863 | 582 | gp: AF008931_1 | *Salmonella typhimurium* GP660 hprt | 51.5 | 83.0 | 165 | hypoxanthine phosphoribosyltransferase |
| 2966 | 6466 | 2871389 | 2870499 | 891 | sp: YZC5_MYCTU | *Mycobacterium tuberculosis* H37Rv Rv3625c | 41.0 | 66.8 | 310 | cell cycle protein MesJ or cytosine deaminase-related protein |
| 2967 | 6467 | 2872677 | 2871445 | 1233 | sp: DAC_ACTSP | *Actinomadura* sp. R39 dac | 27.2 | 51.4 | 459 | D-alanyl-D-alanine carboxypeptidase |
| 2968 | 6468 | 2872926 | 2873399 | 474 | sp: IPYR_ECOLI | *Escherichia coli* K12 ppa | 49.7 | 73.6 | 159 | inorganic pyrophosphatase |
| 2969 | 6469 | 2873611 | 2873393 | 219 | | | | | | |
| 2970 | 6470 | 2875443 | 2873905 | 1539 | pir: H70886 | *Mycobacterium tuberculosis* H37Rv speE | 56.0 | 80.7 | 507 | spermidine synthase |
| 2971 | 6471 | 2875832 | 2875434 | 399 | sp: Y0B1_MYCTU | *Mycobacterium tuberculosis* H37Rv Rv2600 | 38.6 | 86.4 | 132 | hypothetical membrane protein |
| 2972 | 6472 | 2876280 | 2875870 | 411 | sp: Y0B2_MYCTU | *Mycobacterium tuberculosis* H37Rv Rv2599 | 36.8 | 63.2 | 144 | hypothetical protein |
| 2973 | 6473 | 2876777 | 2876280 | 498 | sp: Y0B3_MYCTU | *Mycobacterium tuberculosis* H37Rv Rv2598 | 36.4 | 60.1 | 173 | hypothetical protein |
| 2974 | 6474 | 2877385 | 2876777 | 609 | sp: Y0B4_MYCTU | *Mycobacterium tuberculosis* H37Rv Rv2597 | 44.6 | 72.3 | 202 | hypothetical protein |
| 2975 | 6475 | 2877703 | 2877455 | 249 | sp: PTBA_BACSU | *Bacillus subtilis* 168 bglP | 30.3 | 59.6 | 89 | PTS system, beta-glucosides-permease II ABC component |
| 2976 | 6476 | 2877858 | 2877595 | 264 | | | | | | |
| 2977 | 6477 | 2879710 | 2878478 | 1233 | gp: AB017795_2 | *Nocardioides* sp. KP7 phdD | 38.0 | 69.6 | 411 | ferredoxin reductase |
| 2978 | 6478 | 2879965 | 2880252 | 288 | gp: SCH69_9 | *Streptomyces coelicolor* A3(2) SCH69.09c | 46.4 | 73.2 | 97 | hypothetical protein |
| 2979 | 6479 | 2880544 | 2880987 | 444 | prf: 2516298U | *Burkholderia pseudomallei* ORFE | 26.7 | 59.3 | 135 | bacterial regulatory protein, marR family |
| 2980 | 6480 | 2880998 | 2884882 | 3885 | | | | | | |
| 2981 | 6481 | 2883304 | 2881844 | 1461 | prf: 2413335A | *Streptomyces roseosporus* cpsB | 28.4 | 51.6 | 1241 | peptide synthase |
| 2982 | 6482 | 2886497 | 2884935 | 1563 | prf: 2310295A | *Escherichia coli* K12 padA | 35.0 | 63.7 | 488 | phenylacetaldehyde dehydrogenase |
| 2983 | 6483 | 2887833 | 2886916 | 918 | gp: CJ11168X2_254 | *Campylobacter jejuni* Cj0604 | 57.3 | 79.7 | 241 | hypothetical protein |
| 2984 | 6484 | 2890185 | 2890346 | 162 | GP: MSGTCWPA_1 | *Mycobacterium tuberculosis* | 62.0 | 63.0 | 54 | hypothetical protein |
| 2985 | 6485 | 2890377 | 2890553 | 177 | GP: MSGTCWPA_1 | *Mycobacterium tuberculosis* | 74.0 | 80.0 | 31 | hypothetical protein |
| 2986 | 6486 | 2890540 | 2888897 | 1644 | gsp: R94368 | *Brevibacterium flavum* MJ-233 | 99.5 | 100.0 | 548 | heat shock protein or chaperon or groEL protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 2987 | 6487 | 2890930 | 2890751 | 180 | | | | | | |
| 2988 | 6488 | 2892138 | 2890930 | 1209 | | | | | | |
| 2989 | 6489 | 2893100 | 2892138 | 963 | | | | | | |
| 2990 | 6490 | 2895085 | 2893100 | 1986 | | | | | | |
| 2991 | 6491 | 2897525 | 2895072 | 2454 | | | | | | |
| 2992 | 6492 | 2900326 | 2897528 | 2799 | | | | | | |
| 2993 | 6493 | 2903920 | 2900330 | 3591 | prf: 2309326A | Homo sapiens MUC5B | 21.7 | 42.3 | 1236 | hypothetical protein |
| 2994 | 6494 | 2906738 | 2903964 | 2775 | | | | | | |
| 2995 | 6495 | 2907250 | 2906639 | 612 | | | | | | |
| 2996 | 6496 | 2907515 | 2908885 | 1371 | pir: G70870 | Mycobacterium tuberculosis H37Rv Rv2522c | 37.1 | 68.0 | 447 | peptidase |
| 2997 | 6497 | 2909210 | 2909788 | 579 | | | | | | |
| 2998 | 6498 | 2909830 | 2909231 | 600 | | | | | | |
| 2999 | 6499 | 2910172 | 2913228 | 3057 | prf: 250428SB | Staphylococcus aureus mnhA | 35.6 | 68.3 | 797 | Na+/H+ antiporter or multiple resistance and pH regulation related protein A or NADH dehydrogenase |
| 3000 | 6500 | 2913235 | 2913723 | 489 | gp: AF097740_3 | Bacillus firmus OF4 mrpC | 44.2 | 81.7 | 104 | Na+/H+ antiporter or multiple resistance and pH regulation related protein C or cation transport system protein |
| 3001 | 6501 | 2913749 | 2915416 | 1668 | gp: AF097740_4 | Bacillus firmus OF4 mrpD | 35.2 | 72.1 | 523 | Na+/H+ antiporter or multiple resistance and pH regulation related protein D |
| 3002 | 6502 | 2915482 | 2915922 | 441 | gp: AF097740_5 | Bacillus firmus OF4 mrpE | 26.7 | 60.9 | 161 | Na+/H+ antiporter or multiple resistance and pH regulation related protein E |
| 3003 | 6503 | 2915929 | 2916201 | 273 | prf: 2416476G | Rhizobium meliloti phaF | 32.5 | 66.2 | 77 | K+ efflux system or multiple resistance and pH regulation related protein F |
| 3004 | 6504 | 2916205 | 2916582 | 378 | prf: 250428SH | Staphylococcus aureus mnhG | 25.6 | 63.6 | 121 | Na+/H+ antiporter or multiple resistance and pH regulation related protein G |
| 3005 | 6505 | 2917617 | 2917024 | 594 | pir: D70594 | Mycobacterium tuberculosis H37Rv lipV | 24.7 | 54.5 | 178 | hypothetical protein |
| 3006 | 6506 | 2918757 | 2917630 | 1128 | sp: YBDK_ECOLI | Escherichia coli K12 ybdK | 27.0 | 61.7 | 334 | hypothetical protein |
| 3007 | 6507 | 2919481 | 2918819 | 663 | sp: DEF_BACSU | Bacillus subtilis 168 def | 37.5 | 60.9 | 184 | polypeptide deformylase |
| 3008 | 6508 | 2919715 | 2920293 | 579 | pir: D70631 | Mycobacterium tuberculosis H37Rv Rv0430 | 47.9 | 70.4 | 71 | hypothetical protein |
| 3009 | 6509 | 2919741 | 2919490 | 252 | | | | | | |
| 3010 | 6510 | 2920286 | 2921290 | 1005 | pir: B70631 | Mycobacterium tuberculosis H37Rv Rv0428c | 31.3 | 54.2 | 339 | acetyltransferase (GNAT) family or N terminal acetylating enzyme |
| 3011 | 6511 | 2920476 | 2919808 | 669 | | | | | | |
| 3012 | 6512 | 2920849 | 2920220 | 630 | | | | | | |
| 3013 | 6513 | 2921320 | 2922108 | 789 | gp: AF108767_1 | Salmonella typhimurium LT2 xthA | 30.8 | 59.9 | 31 | exodeoxyribonuclease III or exonuclease |
| 3014 | 6514 | 2922118 | 2923617 | 1500 | gp: BFU88888_2 | Bacillus firmus OF4 cls | 27.9 | 62.0 | 513 | cardiolipin synthase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3015 | 6515 | 2924191 | 2924844 | 654 | sp: BCR_ECOLI | Escherichia coli K12 bcr | 31.6 | 67.2 | 393 | membrane transport protein or bicyclomycin resistance protein |
| 3016 | 6516 | 2925147 | 2923954 | 1194 | | | | | | |
| 3017 | 6517 | 2925541 | 2926704 | 1164 | gp: VCAJ10968_1 | Vibrio cholerae JS1569 nptA | 28.5 | 68.9 | 382 | sodium dependent phosphate pump |
| 3018 | 6518 | 2927546 | 2926707 | 840 | sp: PHZC_PSEAR | Pseudomonas aureofaciens 30-84 phzC | 38.8 | 56.4 | 289 | phenazine biosynthesis protein |
| 3019 | 6519 | 2928283 | 2927651 | 633 | | | | | | |
| 3020 | 6520 | 2928318 | 2927551 | 768 | gp: SCE8_16 | Streptomyces coelicolor A3(2) SCE8.16c | 24.3 | 60.8 | 255 | ABC transporter |
| 3021 | 6521 | 2929237 | 2928302 | 936 | sp: BCRA_BACLI | Bacillus licheniformis ATCC 9945A bcrA | 36.9 | 66.3 | 309 | ABC transporter ATP-binding protein |
| 3022 | 6522 | 2929756 | 2929256 | 501 | pir: C70629 | Mycobacterium tuberculosis H37Rv Rv0413 | 47.6 | 68.5 | 168 | mutator mutT protein |
| 3023 | 6523 | 2929951 | 2931336 | 1386 | pir: B70629 | Mycobacterium tuberculosis H37Rv Rv0412c | 35.0 | 70.2 | 423 | hypothetical membrane protein |
| 3024 | 6524 | 2931340 | 2932371 | 1032 | sp: GLNH_BACST | Bacillus stearothermophilus NUB36 glnH | 31.5 | 64.8 | 270 | glutamine-binding protein precursor |
| 3025 | 6525 | 2932577 | 2934829 | 2253 | plr: H70628 | Mycobacterium tuberculosis H37Rv Rv0410c pknG | 41.2 | 63.5 | 805 | serine/threonine kinase |
| 3026 | 6526 | 2933398 | 2932652 | 747 | sp: ADRO_BOVIN | Bos taurus | 37.2 | 67.8 | 457 | ferredoxin/ferredoxin-NADP reductase |
| 3027 | 6527 | 2938403 | 2939767 | 1365 | | | | | | |
| 3028 | 6528 | 2939907 | 2940452 | 546 | sp: ELAA_ECOLI | Escherichia coli K12 elaA | 34.0 | 60.3 | 156 | acetyltransferase (GNAT) family |
| 3029 | 6529 | 2941508 | 2940447 | 1062 | | | | | | |
| 3030 | 6530 | 2942500 | 2941472 | 1029 | | | | | | |
| 3031 | 6531 | 2943007 | 2942609 | 399 | | | | | | |
| 3032 | 6532 | 2944205 | 2943012 | 1194 | sp: PURT_BACSU | Bacillus subtilis 168 purT | 59.1 | 82.6 | 379 | phosphoribosylglycinamide formyltransferase |
| 3033 | 6533 | 2946526 | 2945639 | 888 | | | | | | |
| 3034 | 6534 | 2947591 | 2946698 | 894 | pir: S60890 | Corynebacterium glutamicum orf2 | 77.6 | 90.9 | 295 | insertion element (IS3 related) |
| 3035 | 6535 | 2947886 | 2947620 | 267 | pir: S60889 | Corynebacterium glutamicum orf1 | 67.4 | 84.3 | 89 | insertion element (IS3 related) |
| 3036 | 6536 | 2949188 | 2948049 | 1140 | gp: AB016841_1 | Streptomyces thermoviolaceus opc-520 chiS | 22.4 | 51.3 | 349 | two-component system sensor histidine kinase |
| 3037 | 6537 | 2949882 | 2949265 | 618 | sp: DEGU_BACBR | Bacillus brevis ALK36 degU | 31.7 | 65.6 | 218 | transcriptional regulator |
| 3038 | 6538 | 2950207 | 2950431 | 225 | | | | | | |
| 3039 | 6539 | 2951723 | 2950434 | 1290 | gp: AB003160_1 | Corynebacterium ammoniagenes purA | 89.7 | 95.3 | 427 | adenylosuccinate synthetase |
| 3040 | 6540 | 2951933 | 2952691 | 759 | pir: G70575 | Mycobacterium tuberculosis H37Rv Rv0358 | 34.3 | 59.3 | 204 | hypothetical protein |
| 3041 | 6541 | 2952709 | 2952972 | 264 | | | | | | |
| 3042 | 6542 | 2954141 | 2952975 | 1167 | sp: YFDA_CORGL | Corynebacterium glutamicum AS019 ATCC 13059 ORF3 | 100.0 | 100.0 | 359 | hypothetical membrane protein |
| 3043 | 6543 | 2955272 | 2954241 | 1032 | pir: S09283 | Corynebacterium glutamicum AS019 ATCC 13059 fda | 99.7 | 100.0 | 344 | fructose-bisphosphate aldolase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3044 | 6544 | 2956473 | 2955523 | 951 | gp: CGFDA_1 | Corynebacterium glutamicum AS019 ATCC 13059 ORF1 | 100.0 | 100.0 | 304 | hypothetical protein |
| 3045 | 6545 | 2957447 | 2956830 | 618 | pir: G70833 | Mycobacterium tuberculosis H37Rv Rv0380c | 76.9 | 91.2 | 182 | methyltransferase |
| 3046 | 6546 | 2958036 | 2957485 | 552 | gp: AF058713_1 | Pyrococcus abyssi pyrE | 39.1 | 65.5 | 174 | orotate phosphoribosyltransferase |
| 3047 | 6547 | 2959110 | 2958139 | 972 | pir: B70834 | Mycobacterium tuberculosis H37Rv Rv0383c | 27.6 | 60.0 | 250 | hypothetical protein |
| 3048 | 6548 | 2960371 | 2959520 | 852 | sp: THTM_HUMAN | Homo sapiens mpsT | 29.6 | 56.1 | 294 | 3-mercaptopyruvate sulfurtransferase |
| 3049 | 6549 | 2961187 | 2960468 | 720 | | | | | | |
| 3050 | 6550 | 2963008 | 2962730 | 279 | | | | | | |
| 3051 | 6551 | 2963596 | 2963198 | 399 | | | | | | |
| 3052 | 6552 | 2964258 | 2964434 | 177 | GSP: Y29188 | Pseudomonas aeruginosa ORF24222 | 76.0 | 82.0 | 59 | virulence factor |
| 3053 | 6553 | 2965076 | 2965837 | 762 | GSP: Y29182 | Pseudomonas aeruginosa ORF23228 | 38.0 | 55.0 | 200 | virulence factor |
| 3054 | 6554 | 2965188 | 2965583 | 396 | GSP: Y29193 | Pseudomonas aeruginosa ORF25110 | 62.0 | 63.0 | 132 | virulence factor |
| 3055 | 6555 | 2967804 | 2966458 | 1347 | pir: S76683 | Synechocystis sp. PCC6803 slr0625 | 24.7 | 54.8 | 489 | sodium/glutamate symport carrier protein |
| 3056 | 6556 | 2968403 | 2968789 | 387 | sp: CADF_STAAU | Staphylococcus aureus cadC | 37.0 | 71.3 | 108 | cadmium resistance protein |
| 3057 | 6557 | 2968951 | 2969808 | 858 | pir: H75109 | Pyrococcus abyssi Orsay PAB0462 | 23.7 | 63.3 | 283 | cation efflux system protein (zinc/cadmium) |
| 3058 | 6558 | 2969834 | 2971003 | 1170 | gp: AB010439_1 | Rhodococcus rhodochrous IFO3338 | 22.5 | 45.4 | 476 | monooxygenase or oxidoreductase or steroid monooxygenase |
| 3059 | 6559 | 2971017 | 2972057 | 1041 | sp: LUXA_KRYAS | Kryptophanaron alfredi symbiont luxA | 21.1 | 47.4 | 399 | alkanal monooxygenase alpha chain |
| 3060 | 6560 | 2972099 | 2971338 | 762 | sp: METB_ECOLI | Escherichia coli K12 metB | 36.5 | 62.4 | 375 | cystathionine gamma-lyase |
| 3061 | 6561 | 2973205 | 2972060 | 1146 | gp: SC1A2_11 | Streptomyces coelicolor A3(2) SC1A2.11 | 40.2 | 67.9 | 184 | bacterial regulatory protein, lacI family |
| 3062 | 6562 | 2973796 | 2973230 | 567 | | | | | | |
| 3063 | 6563 | 2973961 | 2974200 | 240 | gp: SCE20_34 | Streptomyces coelicolor A3(2) SCE20.34c arr | 49.4 | 65.2 | 89 | rifampin ADP-ribosyl transferase |
| 3064 | 6564 | 2974200 | 2974382 | 183 | gp: SCE20_34 | Streptomyces coelicolor A3(2) SCE20.34c arr | 73.2 | 87.5 | 56 | rifampin ADP-ribosyl transferase |
| 3065 | 6565 | 2974467 | 2975591 | 1125 | pir: E70812 | Mycobacterium tuberculosis H37Rv Rv0837c | 30.5 | 56.2 | 361 | hypothetical protein |
| 3066 | 6566 | 2975629 | 2976360 | 732 | pir: D70812 | Mycobacterium tuberculosis H37Rv Rv0836c | 33.8 | 64.7 | 204 | hypothetical protein |
| 3067 | 6567 | 2976596 | 2977774 | 1179 | pir: D70834 | Mycobacterium tuberculosis H37Rv Rv0385 | 31.9 | 60.6 | 386 | oxidoreductase |
| 3068 | 6568 | 2978644 | 2977847 | 798 | pir: B69109 | Methanobacterium thermoautotrophicum Delta H MTH1811 | 32.0 | 67.3 | 275 | N-carbamoyl-D-amino acid amidohydrolase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3069 | 6569 | 2978737 | 2978979 | 243 | | | | | | |
| 3070 | 6570 | 2978982 | 2980115 | 1134 | gp: SC4A7_3 | *Streptomyces coelicolor* A3(2) SC4A7.03 | 28.0 | 55.4 | 289 | hypothetical protein |
| 3071 | 6571 | 2980887 | 2981216 | 330 | GP: ABCARRA_2 | *Azospirillum brasilense* carR | 38.0 | 44.0 | 108 | novel two-component regulatory system |
| 3072 | 6572 | 2981698 | 2980181 | 1518 | prf: 2104333D | *Rhodococcus erythropolis* thcA | 69.6 | 90.3 | 507 | aldehyde dehydrogenase |
| 3073 | 6573 | 2982460 | 2982023 | 438 | gp: SAU43299_2 | *Streptomyces albus* G hspR | 47.4 | 70.4 | 135 | heat shock transcription regulator |
| 3074 | 6574 | 2983679 | 2982495 | 1185 | sp: DNAJ_MYCTU | *Mycobacterium tuberculosis* H37Rv RV0352 dnaJ | 56.7 | 80.1 | 397 | heat shock protein dnaJ |
| 3075 | 6575 | 2984522 | 2983887 | 636 | sp: GRPE_STRCO | *Streptomyces coelicolor* grpE | 38.7 | 66.5 | 212 | nucleotide exchange factor grpE protein bound to the ATPase domain of the molecular chaperone DnaK |
| 3076 | 6576 | 2986397 | 2984544 | 1854 | gsp: R94587 | *Brevibacterium flavum* MJ-233 dnaK | 99.8 | 99.8 | 618 | heat shock protein dnaK |
| 3077 | 6577 | 2986833 | 2988164 | 1332 | gp: SCF6_8 | *Streptomyces coelicolor* A3(2) SCF6.09 | 42.6 | 79.0 | 338 | hypothetical membrane protein |
| 3078 | 6578 | 2988846 | 2988214 | 633 | sp: PFS_HELPY | *Helicobacter pylori* HP0089 mtn | 27.2 | 60.0 | 195 | 5'-methylthioadenosine nucleosidase and S-adenosylhomocysteine nucleosidase |
| 3079 | 6579 | 2990045 | 2988846 | 1200 | | | | | | |
| 3080 | 6580 | 2991718 | 2992602 | 885 | | | | | | |
| 3081 | 6581 | 2993286 | 2988954 | 3333 | sp: CUT3_SCHPO | *Schizosaccharomyces pombe* cut3 | 18.9 | 48.4 | 1311 | chromosome segregation protein |
| 3082 | 6582 | 2993921 | 2993286 | 636 | | | | | | |
| 3083 | 6583 | 2995405 | 2993921 | 1485 | | | | | | |
| 3084 | 6584 | 2996781 | 2995747 | 1035 | sp: ADH2_BACST | *Bacillus stearothermophilus* DSM 2334 adh | 50.0 | 81.7 | 334 | alcohol dehydrogenase |
| 3085 | 6585 | 2997151 | 2997366 | 216 | | | | | | |
| 3086 | 6586 | 2997687 | 2997481 | 207 | | | | | | |
| 3087 | 6587 | 2997688 | 2997876 | 189 | | | | | | |
| 3088 | 6588 | 2998223 | 2997963 | 261 | | | | | | |
| 3089 | 6589 | 2999454 | 2998528 | 927 | pir: F69997 | *Bacillus subtilis* ytnM | 43.5 | 70.1 | 301 | hypothetical membrane protein |
| 3090 | 6590 | 3000200 | 2999478 | 723 | gp: SC7A8_10 | *Streptomyces coelicolor* A3(2) SC7A8.10c | 32.5 | 53.2 | 252 | hypothetical protein |
| 3091 | 6591 | 3001512 | 3002426 | 915 | sp: CYSN_ECOLI | *Escherichia coli* K12 cysN | 47.3 | 78.3 | 414 | sulfate adenylyltransferase, subunit 1 |
| 3092 | 6592 | 3001539 | 3000241 | 1299 | sp: CYSD_ECOLI | *Escherichia coli* K12 cysD | 46.1 | 70.1 | 308 | sulfate adenylyltransferase small chain |
| 3093 | 6593 | 3002453 | 3001542 | 912 | | | | | | |
| 3094 | 6594 | 3003145 | 3002453 | 693 | sp: CYH1_BACSU | *Bacillus subtilis* cysH | 39.2 | 64.2 | 212 | phosphoadenosine phosphosulfate reductase |
| 3095 | 6595 | 3005162 | 3003480 | 1683 | sp: NIR_SYNP7 | *Synechococcus* sp. PCC 7942 | 34.5 | 65.5 | 502 | ferredoxin—nitrate reductase |
| 3096 | 6596 | 3005545 | 3006915 | 1371 | sp: ADRO_YEAST | *Saccharomyces cerevisiae* FL200 arh1 | 30.8 | 61.4 | 487 | ferredoxin/ferredoxin-NADP reductase |
| 3097 | 6597 | 3007294 | 3008376 | 1083 | prf: 2420294J | *Homo sapiens* hypE | 32.6 | 59.7 | 144 | huntingtin interactor |
| 3098 | 6598 | 3008689 | 3008453 | 237 | | | | | | |
| 3099 | 6599 | 3008770 | 3009303 | 534 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3100 | 6600 | 3009162 | 3008749 | 414 | sp: PHNB_ECOLI | Escherichia coli K12 phnB | 26.8 | 59.9 | 142 | alkylphosphonate uptake protein and C-P lyase activity |
| 3101 | 6601 | 3009242 | 3009607 | 366 | gp: SCE68_10 | Streptomyces coelicolor A3(2) SCE68.10 | 50.0 | 66.3 | 80 | hypothetical protein |
| 3102 | 6602 | 3010231 | 3009710 | 522 | gp: PPAMOA_1 | Pseudomonas putida DSMZ ID 88-260 amoA | 39.1 | 76.4 | 161 | ammonia monooxygenase |
| 3103 | 6603 | 3010659 | 3010979 | 321 | | | | | | |
| 3104 | 6604 | 3010926 | 3010441 | 486 | | | | | | |
| 3105 | 6605 | 3010989 | 3011273 | 285 | SP: YTZ3_AGRVI | Agrobacterium vitis ORFZ3 | 41.0 | 58.0 | 68 | hypothetical protein |
| 3106 | 6606 | 3011805 | 3011242 | 564 | sp: YGB7_ALCEU | Alcaligenes eutrophus H16 ORF7 | 26.1 | 57.9 | 337 | hypothetical protein |
| 3107 | 6607 | 3012809 | 3011808 | 1002 | | | | | | |
| 3108 | 6608 | 3013798 | 3013106 | 693 | gp: HIU68399_3 | Haemophilus influenzae hmcB | 35.7 | 64.8 | 199 | ABC transporter |
| 3109 | 6609 | 3014550 | 3013837 | 714 | gp: HIU68399_3 | Haemophilus influenzae hmcB | 39.3 | 73.0 | 211 | ABC transporter |
| 3110 | 6610 | 3014616 | 3015824 | 1209 | pir: A69778 | Bacillus subtilis ydeG | 30.8 | 67.8 | 416 | metabolite transport protein homolog |
| 3111 | 6611 | 3015469 | 3014648 | 822 | | | | | | |
| 3112 | 6612 | 3016238 | 3016924 | 687 | | | | | | |
| 3113 | 6613 | 3017149 | 3015827 | 1323 | sp: DAPE_ECOLI | Escherichia coli K12 msgB | 21.5 | 48.5 | 466 | succinyl-diaminopimelate desuccinylase |
| 3114 | 6614 | 3017316 | 3019220 | 1905 | | | | | | |
| 3115 | 6615 | 3017539 | 3018312 | 774 | | | | | | |
| 3116 | 6616 | 3018181 | 3017420 | 762 | | | | | | |
| 3117 | 6617 | 3019076 | 3018123 | 954 | GPU: DCA297422_1 | Daucus carota | 33.0 | 46.0 | 114 | dehydrin-like protein |
| 3118 | 6618 | 3020609 | 3019542 | 1068 | sp: MALK_ECOLI | Escherichia coli K12 malK | 24.9 | 50.1 | 373 | maltose/maltodextrin transport ATP-binding protein |
| 3119 | 6619 | 3021202 | 3020561 | 642 | gp: AF036485_6 | Lactococcus lactis Plasmid pNZ4000 Orf-200 cbiM | 30.2 | 67.6 | 179 | cobalt transport protein |
| 3120 | 6620 | 3021825 | 3021208 | 618 | | | | | | |
| 3121 | 6621 | 3022928 | 3022113 | 816 | sp: FRP_VIBHA | Vibrio harveyi MAV frp | 37.2 | 71.4 | 231 | NADPH-flavin oxidoreductase |
| 3122 | 6622 | 3023900 | 3022998 | 903 | sp: IUNH_CRIFA | Crithidia fasciculata iunH | 28.4 | 59.3 | 317 | inosine-uridine preferring nucleoside hydrolase |
| 3123 | 6623 | 3024379 | 3025353 | 975 | gp: SCE20_8 | Streptomyces coelicolor A3(2) SCE20.08c | 31.2 | 59.4 | 276 | hypothetical membrane protein |
| 3124 | 6624 | 3025552 | 3026139 | 588 | sp: 3MG1_ECOLI | Escherichia coli K12 tag | 50.3 | 78.8 | 179 | DNA-3-methyladenine glycosylase |
| 3125 | 6625 | 3027299 | 3026142 | 1158 | sp: HMPA_ALCEU | Alcaligenes eutrophus H16 fhp | 33.5 | 63.8 | 406 | flavohemoprotein |
| 3126 | 6626 | 3027561 | 3028163 | 603 | | | | | | |
| 3127 | 6627 | 3028268 | 3028891 | 624 | gp: SCO276673_18 | Streptomyces coelicolor A3(2) mmyQ | 34.8 | 63.8 | 210 | oxidoreductase |
| 3128 | 6628 | 3028878 | 3029033 | 156 | | | | | | |
| 3129 | 6629 | 3029474 | 3028884 | 591 | sp: BGLG_ECOLI | Escherichia coli K12 bglC | 28.1 | 69.3 | 192 | transcription antiterminator or beta-glucoside positive regulatory protein |
| 3130 | 6630 | 3029504 | 3029782 | 279 | | | | | | |
| 3131 | 6631 | 3030061 | 3029702 | 360 | sp: ABGA_CLOLO | Clostridium longisporum B6405 abgA | 43.7 | 59.9 | 167 | 6-phospho-beta-glucosidase |
| 3132 | 6632 | 3030155 | 3030535 | 381 | | | | | | |
| 3133 | 6633 | 3030340 | 3030101 | 240 | sp: ABGA_CLOLO | Clostridium longisporum B6405 abgA | 43.9 | 78.8 | 66 | 6-phospho-beta-glucosidase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3134 | 6634 | 3030723 | 3031979 | 1257 | gp: L78665_2 | *Methylobacillus flagellatus* aat | 53.7 | 80.9 | 402 | aspartate aminotransferase |
| 3135 | 6635 | 3032647 | 3032348 | 300 | | | | | | |
| 3136 | 6636 | 3032661 | 3033863 | 1203 | gp: AF189147_1 | *Corynebacterium glutamicum* ATCC 13032 tnp | 100.0 | 100.0 | 401 | transposase (ISCg2) |
| 3137 | 6637 | 3034181 | 3035437 | 1257 | gp: SCQ11_10 | *Streptomyces coelicolor* A3(2) SCQ11.10c | 33.6 | 70.2 | 399 | hypothetical membrane protein |
| 3138 | 6638 | 3034287 | 3034105 | 183 | | | | | | |
| 3139 | 6639 | 3036756 | 3035440 | 1317 | prf: 2422381B | *SinoRhizobium meliloti* rkpK | 40.5 | 72.2 | 442 | UDP-glucose dehydrogenase |
| 3140 | 6640 | 3037411 | 3036845 | 567 | sp: DCD_ECOLI | *Escherichia coli* K12 dcd | 43.6 | 72.3 | 188 | deoxycytidine triphosphate deaminase |
| 3141 | 6641 | 3037675 | 3037911 | 237 | | | | | | |
| 3142 | 6642 | 3038172 | 3038942 | 771 | gp: SCC75A_16 | *Streptomyces coelicolor* A3(2) SCC75A.16c | 30.6 | 59.4 | 229 | hypothetical protein |
| 3143 | 6643 | 3040681 | 3038993 | 1689 | | | | | | |
| 3144 | 6644 | 3041932 | 3040748 | 1185 | gp: AB008771_1 | *Streptomyces thermoviolaceus* nagA | 28.5 | 58.1 | 410 | beta-N-Acetylglucosaminidase |
| 3145 | 6645 | 3041994 | 3042437 | 444 | | | | | | |
| 3146 | 6646 | 3042503 | 3042703 | 201 | | | | | | |
| 3147 | 6647 | 3042660 | 3045788 | 3129 | gp: MLCB1883_7 | *Mycobacterium leprae* MLCB1883.13c | 29.6 | 49.4 | 1416 | hypothetical protein |
| 3148 | 6648 | 3043642 | 3043022 | 621 | | | | | | |
| 3149 | 6649 | 3045796 | 3045990 | 195 | | | | | | |
| 3150 | 6650 | 3047146 | 3048048 | 903 | gp: MLCB1883_4 | *Mycobacterium leprae* MLCB1883.05c | 24.8 | 47.1 | 363 | hypothetical membrane protein |
| 3151 | 6651 | 3047189 | 3046122 | 1068 | pir: JC4001 | *Streptomyces* sp. acyA | 27.7 | 51.0 | 408 | acyltransferase or macrolide 3-O-acyltransferase |
| 3152 | 6652 | 3047904 | 3047197 | 708 | | | | | | |
| 3153 | 6653 | 3048058 | 3049479 | 1422 | gp: MLCB1883_3 | *Mycobacterium leprae* MLCB1883.04c | 31.2 | 54.8 | 529 | hypothetical membrane protein |
| 3154 | 6654 | 3050522 | 3051190 | 669 | | | | | | |
| 3155 | 6655 | 3050592 | 3049456 | 1137 | pir: G70961 | *Mycobacterium tuberculosis* H37Rv Rv0225 | 53.4 | 79.1 | 369 | hexosyltransferase |
| 3156 | 6656 | 3051194 | 3051964 | 771 | pir: F70961 | *Mycobacterium tuberculosis* H37Rv Rv0224c | 58.6 | 73.3 | 251 | methyl transferase |
| 3157 | 6657 | 3053891 | 3052062 | 1830 | sp: PPCK_NEOFR | *Neocallimastix frontalis* pepck | 54.7 | 78.5 | 601 | phosphoenolpyruvate carboxykinase (GTP) |
| 3158 | 6658 | 3054759 | 3055769 | 1011 | pir: E75125 | *Pyrococcus abyssi* Orsay PAB2393 | 24.4 | 52.7 | 332 | C4-dicarboxylate transporter |
| 3159 | 6659 | 3055867 | 3056631 | 765 | sp: YGGH_ECOLI | *Escherichia coli* K12 yggH | 35.7 | 67.2 | 241 | hypothetical protein |
| 3160 | 6660 | 3056613 | 3057317 | 705 | pir: E70959 | *Mycobacterium tuberculosis* H37Rv Rv0207c | 69.1 | 85.0 | 207 | hypothetical protein |
| 3161 | 6661 | 3057328 | 3059643 | 2316 | pir: C70839 | *Mycobacterium tuberculosis* H37Rv Rv0206c mmpL3 | 42.3 | 72.3 | 768 | mebrane transport protein |
| 3162 | 6662 | 3059517 | 3058096 | 1422 | | | | | | |
| 3163 | 6663 | 3059651 | 3060733 | 1083 | pir: A70839 | *Mycobacterium tuberculosis* H37Rv Rv0204c | 29.1 | 62.9 | 364 | hypothetical membrane protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3164 | 6664 | 3060733 | 3061095 | 363 | pir: H70633 | *Mycobacterium tuberculosis* H37Rv Rv0401 | 34.3 | 69.4 | 108 | hypothetical membrane protein |
| 3165 | 6665 | 3062927 | 3061380 | 1548 | gp: AF113605_1 | *Streptomyces coelicolor* A3(2) pccB | 49.7 | 76.9 | 523 | propionyl-CoA carboxylase complex B subunit |
| 3166 | 6666 | 3067780 | 3062951 | 4830 | sp: ERY1_SACER | *Streptomyces erythraeus* eryA | 30.2 | 54.2 | 1747 | polyketide synthase |
| 3167 | 6667 | 3069930 | 3068143 | 1788 | prf: 2310345A | *Mycobacterium bovis* BCG | 33.5 | 62.3 | 592 | acyl-CoA synthase |
| 3168 | 6668 | 3071140 | 3070214 | 927 | pir: F70887 | *Mycobacterium tuberculosis* H37Rv Rv3802c | 39.8 | 67.4 | 319 | hypothetical protein |
| 3169 | 6669 | 3071644 | 3071147 | 498 | | | | | | |
| 3170 | 6670 | 3073620 | 3071650 | 1971 | sp: CSP1_CORGL | *Corynebacterium glutamicum* (*Brevibacterium flavum*) ATCC 17965 cop1 | 98.6 | 99.5 | 657 | major secreted protein PS1 protein precursor |
| 3171 | 6671 | 3074047 | 3075447 | 1401 | | | | | | |
| 3172 | 6672 | 3074075 | 3073857 | 219 | | | | | | |
| 3173 | 6673 | 3076562 | 3075540 | 1023 | sp: A85C_MYCTU | *Mycobacterium tuberculosis* ERDMANN RV0129C fbpC | 36.3 | 62.5 | 331 | antigen 85-C |
| 3174 | 6674 | 3078772 | 3076715 | 2058 | pir: A70888 | *Mycobacterium tuberculosis* H37Rv Rv3805c | 37.5 | 61.2 | 667 | hypothetical membrane protein |
| 3175 | 6675 | 3079848 | 3078853 | 996 | sp: NOEC_AZOCA | *Azorhizobium caulinodans* ORS571 noeC | 27.1 | 51.5 | 295 | nodulation protein |
| 3176 | 6676 | 3080351 | 3079848 | 504 | pir: C70888 | *Mycobacterium tuberculosis* H37Rv Rv3807c | 51.2 | 75.0 | 168 | hypothetical protein |
| 3177 | 6677 | 3082311 | 3080344 | 1968 | pir: D70888 | *Mycobacterium tuberculosis* H37Rv Rv3808c | 55.6 | 74.7 | 656 | hypothetical protein |
| 3178 | 6678 | 3082467 | 3083960 | 1494 | | | | | | |
| 3179 | 6679 | 3084411 | 3083935 | 477 | sp: BCRC_BACLI | *Bacillus licheniformis* ATCC 9945A bcrC | 28.2 | 56.5 | 170 | phosphatidic acid phosphatase |
| 3180 | 6680 | 3085200 | 3084424 | 777 | | | | | | |
| 3181 | 6681 | 3085727 | 3085218 | 510 | | | | | | |
| 3182 | 6682 | 3085747 | 3087048 | 1302 | sp: FMO1_PIG | *Sus scrofa* fmo1 | 24.4 | 50.4 | 377 | dimethylaniline monooxygenase (N-oxide-forming) |
| 3183 | 6683 | 3087665 | 3088276 | 612 | sp: GLF_ECOLI | *Escherichia coli* K12 glf | 43.2 | 72.9 | 377 | UDP-galactopyranose mutase |
| 3184 | 6684 | 3088303 | 3087101 | 1203 | pir: G70520 | *Mycobacterium tuberculosis* H37Rv Rv3811 csp | 29.6 | 47.8 | 659 | hypothetical protein |
| 3185 | 6685 | 3088616 | 3090664 | 2049 | | | | | | |
| 3186 | 6686 | 3092286 | 3090760 | 1527 | sp: GLPK_PSEAE | *Pseudomonas aeruginosa* ATCC 15692 glpK | 51.7 | 78.8 | 499 | glycerol kinase |
| 3187 | 6687 | 3093175 | 3092342 | 834 | pir: A70521 | *Mycobacterium tuberculosis* H37Rv Rv3813c | 41.6 | 70.3 | 279 | hypothetical protein |
| 3188 | 6688 | 3094050 | 3093175 | 876 | pir: D70521 | *Mycobacterium tuberculosis* H37Rv Rv3816c | 46.7 | 72.0 | 261 | acyltransferase |
| 3189 | 6689 | 3095343 | 3094078 | 1266 | gsp: W26465 | *Mycobacterium tuberculosis* H37Rv | 70.2 | 87.6 | 419 | seryl-tRNA synthetase |
| 3190 | 6690 | 3095574 | 3096287 | 714 | sp: FARR_ECOLI | *Escherichia coli* K12 farR | 27.7 | 61.7 | 235 | transcriptional regulator, GntR family or fatty acyl-responsive regulator |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3191 | 6691 | 3096311 | 3097423 | 1113 | pir: H70652 | Mycobacterium tuberculosis H37Rv Rv3835 | 32.6 | 61.2 | 356 | hypothetical protein |
| 3192 | 6692 | 3097423 | 3097764 | 342 | pir: A70653 | Mycobacterium tuberculosis H37Rv Rv3836 | 46.0 | 79.7 | 113 | hypothetical protein |
| 3193 | 6693 | 3097878 | 3097780 | 99 | | | | | | |
| 3194 | 6694 | 3098572 | 3097904 | 669 | gp: AMU73808_1 | Amycolatopsis methanolica pgm | 37.2 | 62.8 | 218 | 2,3-PDG dependent phosphoglycerate mutase |
| 3195 | 6695 | 3098825 | 3099454 | 630 | | | | | | |
| 3196 | 6696 | 3099556 | 3100698 | 1143 | prf: 2501285A | Mycobacterium smegmatis pzaA | 27.4 | 50.9 | 460 | nicotinamidase or pyrazinamidase |
| 3197 | 6697 | 3100698 | 3101426 | 729 | | | | | | |
| 3198 | 6698 | 3101734 | 3102768 | 1035 | gp: SC6G4_33 | Streptomyces coelicolor A3(2) SC6G4.33 | 31.6 | 57.1 | 380 | transcriptional regulator |
| 3199 | 6699 | 3101863 | 3101744 | 120 | | | | | | |
| 3200 | 6700 | 3102630 | 3102079 | 552 | | | | | | |
| 3201 | 6701 | 3102894 | 3103763 | 870 | | | | | | |
| 3202 | 6702 | 3103926 | 3104252 | 327 | pir: B26872 | Streptomyces lavendulae ORF372 | 43.9 | 81.3 | 107 | hypothetical protein |
| 3203 | 6703 | 3104406 | 3105719 | 1314 | sp: AMYH_YEAST | Saccharomyces cerevisiae S288C YIR019C sta1 | 28.7 | 55.3 | 432 | glucan 1,4-alpha-glucosidase |
| 3204 | 6704 | 3106970 | 3106053 | 918 | sp: GLPQ_BACSU | Bacillus subtilis glpQ | 29.0 | 54.1 | 259 | glycerophosphoryl diester phosphodiesterase |
| 3205 | 6705 | 3107769 | 3106951 | 819 | sp: GNTP_BACSU | Bacillus subtilis gntP | 37.3 | 71.9 | 456 | gluconate permease |
| 3206 | 6706 | 3108131 | 3109519 | 1389 | sp: KPYK_CORGL | Corynebacterium glutamicum AS019 pyk | 25.5 | 47.7 | 491 | pyruvate kinase |
| 3207 | 6707 | 3109464 | 3108823 | 642 | | | | | | |
| 3208 | 6708 | 3109845 | 3110003 | 159 | | | | | | |
| 3209 | 6709 | 3112080 | 3110464 | 1617 | | | | | | |
| 3210 | 6710 | 3113390 | 3112449 | 942 | gsp: Y25997 | Brevibacterium flavum lctA | 99.7 | 99.7 | 314 | L-lactate dehydrogenase |
| 3211 | 6711 | 3113619 | 3115394 | 1776 | pir: C70893 | Mycobacterium tuberculosis H37Rv Rv1069c | 33.5 | 64.8 | 526 | hypothetical protein |
| 3212 | 6712 | 3115407 | 3116042 | 636 | gp: SC1C2_30 | Streptomyces coelicolor A3(2) SC1C2.30 | 32.1 | 58.5 | 224 | hydrolase or haloacid dehalogenase-like hydrolase |
| 3213 | 6713 | 3116079 | 3116621 | 543 | gp: AF030288_1 | Brevibacterium linens ORF1 tmpA | 39.9 | 67.6 | 188 | efflux protein |
| 3214 | 6714 | 3116640 | 3117332 | 693 | sp: GLCC_ECOLI | Escherichia coli K12 MG1655 glcC | 27.6 | 57.0 | 221 | transcription activator or transcriptional regulator GntR family |
| 3215 | 6715 | 3117336 | 3118121 | 786 | pir: B70885 | Mycobacterium tuberculosis H37Rv Rv2795c | 47.8 | 68.6 | 255 | phosphoesterase |
| 3216 | 6716 | 3118284 | 3119582 | 1299 | sp: SHIA_ECOLI | Escherichia coli K12 shiA | 37.9 | 74.4 | 422 | shikimate transport protein |
| 3217 | 6717 | 3119665 | 3120879 | 1215 | prf: 2219306A | Neisseria meningitidis lldA | 40.4 | 68.9 | 376 | L-lactate dehydrogenase or FMN-dependent dehydrogenase |
| 3218 | 6718 | 3120909 | 3121313 | 405 | sp: RPC_BPPH1 | Bacillus phage phi-105 ORF1 | 45.5 | 80.0 | 55 | immunity repressor protein |
| 3219 | 6719 | 3121598 | 3121909 | 312 | | | | | | |
| 3220 | 6720 | 3122129 | 3121992 | 138 | | | | | | |
| 3221 | 6721 | 3123222 | 3123932 | 711 | | | | | | |
| 3222 | 6722 | 3124172 | 3122556 | 1617 | gp: CELY51B11A_1 | Caenorhabditis elegans Y51B11A.1 | 29.5 | 51.3 | 569 | phosphatase or reverse transcriptase (RNA-dependent) |
| 3223 | 6723 | 3124886 | 3124341 | 546 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3224 | 6724 | 3125298 | 3124897 | 402 | sp: ILL1_ARATH | *Arabidopsis thaliana* ill1 | 36.9 | 63.1 | 122 | peptidase or IAA-amino acid hydrolase |
| 3225 | 6725 | 3125343 | 3125492 | 150 | | | | | | |
| 3226 | 6726 | 3126145 | 3125495 | 651 | sp: PMSR_ECOLI | *Escherichia coli* B msrA | 47.6 | 69.1 | 210 | peptide methionine sulfoxide reductase |
| 3227 | 6727 | 3126392 | 3126991 | 600 | pir: I40858 | *Corynebacterium pseudodiphtheriticum* sod | 82.3 | 92.7 | 164 | superoxide dismutase (Fe/Mn) |
| 3228 | 6728 | 3128417 | 3127494 | 924 | sp: GLTC_BACSU | *Bacillus subtilis* gltC | 32.5 | 65.8 | 292 | transcriptional regulator |
| 3229 | 6729 | 3128606 | 3129739 | 1134 | gp: AF121000_10 | *Corynebacterium glutamicum* tetA | 23.4 | 49.0 | 384 | multidrug resistance transporter |
| 3230 | 6730 | 3129785 | 3131395 | 1611 | | | | | | |
| 3231 | 6731 | 3132920 | 3133030 | 111 | | | | | | |
| 3232 | 6732 | 3133028 | 3131508 | 1521 | | | | | | |
| 3233 | 6733 | 3133115 | 3133747 | 633 | pir: G70654 | *Mycobacterium tuberculosis* H37Rv Rv3850 | 33.8 | 64.8 | 216 | hypothetical protein |
| 3234 | 6734 | 3135268 | 3133778 | 1491 | prf: 2508244AB | *Streptomyces cyanogenus* lanJ | 27.3 | 59.3 | 447 | membrane transport protein |
| 3235 | 6735 | 3135297 | 3135752 | 456 | sp: YXAD_BACSU | *Bacillus subtilis* 168 yxaD | 37.2 | 65.0 | 137 | transcriptional regulator |
| 3236 | 6736 | 3136491 | 3135856 | 636 | prf: 2518330B | *Corynebacterium diphtheriae* chrA | 50.9 | 75.5 | 212 | two-component system response regulator |
| 3237 | 6737 | 3136920 | 3137558 | 639 | | | | | | |
| 3238 | 6738 | 3137884 | 3138471 | 588 | | | | | | |
| 3239 | 6739 | 3137903 | 3136593 | 1311 | prf: 2518330A | *Corynebacterium diphtheriae* chrS | 30.2 | 64.5 | 408 | two-component system sensor histidine kinase |
| 3240 | 6740 | 3138630 | 3138481 | 150 | gp: SCH69_22 | *Streptomyces coelicolor* A3(2) SCH69.22c | 45.8 | 79.2 | 48 | hypothetical protein |
| 3241 | 6741 | 3139455 | 3138634 | 822 | gp: SCH69_20 | *Streptomyces coelicolor* A3(2) SCH69.20c | 30.0 | 59.2 | 277 | hypothetical protein |
| 3242 | 6742 | 3139651 | 3140952 | 1302 | sp: SP3J_BACSU | *Bacillus subtilis* spoIIJ | 26.0 | 53.6 | 265 | stage III sporulation protein |
| 3243 | 6743 | 3141523 | 3140885 | 639 | pir: C70948 | *Mycobacterium tuberculosis* H37Rv Rv3173c | 32.3 | 60.9 | 192 | transcriptional repressor |
| 3244 | 6744 | 3141969 | 3141709 | 261 | sp: TAG1_ECOLI | *Escherichia coli* K12.MG1655 tag 1 | 34.5 | 71.3 | 87 | transglycosylase-associated protein |
| 3245 | 6745 | 3143356 | 3142454 | 903 | sp: YW12_MYCTU | *Mycobacterium tuberculosis* H37Rv Rv2005c | 41.2 | 69.6 | 296 | hypothetical protein |
| 3246 | 6746 | 3144482 | 3143496 | 987 | sp: YHBW_ECOLI | *Escherichia coli* K12 MG1655 yhbW | 38.5 | 73.9 | 314 | hypothetical protein |
| 3247 | 6747 | 3144661 | 3145626 | 966 | sp: YBC5_CHLVI | *Chlorobium vibrioforme* ybc5 | 28.4 | 51.2 | 334 | RNA pseudouridylate synthase |
| 3248 | 6748 | 3146569 | 3146841 | 273 | GSP: Y35814 | *Chlamydia pneumoniae* | 61.0 | 66.0 | 84 | hypothetical protein |
| 3249 | 6749 | 3147090 | 3147230 | 141 | PIR: F81737 | *Chlamydia muridarum* Nigg TC0129 | 71.0 | 75.0 | 42 | hypothetical protein |
| 3250 | 6750 | 3151575 | 3151369 | 207 | | | | | | |
| 3251 | 6751 | 3152204 | 3151842 | 363 | sp: GLCC_ECOLI | *Escherichia coli* K12 MG1655 glcC | 30.3 | 56.0 | 109 | bacterial regulatory protein, gntR family or glc operon transcriptional activator |
| 3252 | 6752 | 3152413 | 3153828 | 1416 | gp: SC4G6_31 | *Streptomyces coelicolor* SC4G6.31c | 26.0 | 48.2 | 488 | hypothetical protein |
| 3253 | 6753 | 3154766 | 3153894 | 873 | sp: 35KD_MYCTU | *Mycobacterium tuberculosis* H37Rv Rv2744c | 48.3 | 78.7 | 267 | hypothetical protein |
| 3254 | 6754 | 3154817 | 3154969 | 153 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3255 | 6755 | 3156697 | 3155246 | 1452 | | | | | | |
| 3256 | 6756 | 3157373 | 3156306 | 1068 | | | | | | |
| 3257 | 6757 | 3157471 | 3157223 | 249 | | | | | | |
| 3258 | 6758 | 3157787 | 3157479 | 309 | | | | | | |
| 3259 | 6759 | 3158124 | 3158834 | 711 | gp: SCD35_11 | *Streptomyces coelicolor* A3(2) SCD35.11c | 32.3 | 58.1 | 217 | methyltransferase |
| 3260 | 6760 | 3159800 | 3159081 | 720 | sp: NO21_SOYBN | soybean NO21 | 26.1 | 55.2 | 241 | nodulin 21-related protein |
| 3261 | 6761 | 3160216 | 3160419 | 204 | | | | | | |
| 3262 | 6762 | 3160688 | 3161065 | 378 | | | | | | |
| 3263 | 6763 | 3160816 | 3161001 | 186 | | | | | | |
| 3264 | 6764 | 3160938 | 3160723 | 216 | sp: TNP5_PSEAE | *Pseudomonas aeruginosa* TNP5 | 48.2 | 92.9 | 56 | transposon tn501 resolvase |
| 3265 | 6765 | 3161219 | 3161701 | 483 | | | | | | |
| 3266 | 6766 | 3161407 | 3161087 | 321 | sp: FER_SACER | *Saccharopolyspora erythraea* fer | 90.3 | 98.4 | 62 | ferredoxin precursor |
| 3267 | 6767 | 3162014 | 3161682 | 333 | gp: SCD31_14 | *Streptomyces coelicolor* A3(2) | 47.3 | 85.5 | 55 | hypothetical protein |
| 3268 | 6768 | 3162694 | 3162804 | 111 | GPU: AF164956_8 | *Corynebacterium glutamicum* Tnp1673 | 81.0 | 84.0 | 27 | transposase |
| 3269 | 6769 | 3162710 | 3162871 | 162 | GPU: AF164956_23 | *Corynebacterium glutamicum* | 84.0 | 90.0 | 46 | transposase protein fragment TnpNC |
| 3270 | 6770 | 3162852 | 3163889 | 1038 | sp: G3P_PYRWO | *Pyrococcus woesei* gap | 63.2 | 84.2 | 38 | glyceraldehyde-3-phosphate dehydrogenase (pseudogene) |
| 3271 | 6771 | 3162983 | 3162858 | 126 | | | | | | |
| 3272 | 6772 | 3163733 | 3163074 | 660 | pir: S77018 | *Synechocystis* sp. PCC6803 sll0788 | 32.2 | 59.4 | 180 | lipoprotein |
| 3273 | 6773 | 3166005 | 3163789 | 2217 | pir: H69268 | *Archaeoglobus fulgidus* AF0152 | 45.8 | 73.4 | 717 | copper/potassium-transporting ATPase B or cation transporting ATPase (E1-E2 family) |
| 3274 | 6774 | 3166437 | 3166267 | 171 | | | | | | |
| 3275 | 6775 | 3166978 | 3167169 | 192 | | | | | | |
| 3276 | 6776 | 3167646 | 3166450 | 1197 | sp: BAES_ECOLI | *Escherichia coli* K12 baeS | 37.5 | 71.4 | 301 | two-component system sensor histidine kinase |
| 3277 | 6777 | 3167739 | 3168566 | 828 | | | | | | |
| 3278 | 6778 | 3168401 | 3167646 | 756 | sp: PHOP_BACSU | *Bacillus subtilis* phoP | 43.4 | 72.1 | 233 | two-component response regulator or alkaline phosphatase synthesis transcriptional regulatory protein |
| 3279 | 6779 | 3168669 | 3169340 | 672 | | | | | | |
| 3280 | 6780 | 3169414 | 3170892 | 1479 | sp: COPA_PSESM | *Pseudomonas syringae* pv. tomato copA | 26.7 | 47.9 | 630 | laccase or copper resistance protein precursor A |
| 3281 | 6781 | 3171254 | 3171616 | 363 | sp: TLPA_BRAJA | *Bradyrhizobium japonicum* tlpA | 31.7 | 63.4 | 101 | thiol: disulfide interchange protein (cytochrome c biogenesis protein) |
| 3282 | 6782 | 3172536 | 3171619 | 918 | sp: QOR_MOUSE | *Mus musculus* qor | 31.4 | 60.9 | 322 | quinone oxidoreductase (NADPH: quinone reductase)(seta-crystallin) |
| 3283 | 6783 | 3172995 | 3173465 | 471 | | | | | | |
| 3284 | 6784 | 3173624 | 3173857 | 234 | sp: ATZN_SYNY3 | *Synechocystis* sp. PCC6803 atzN | 37.2 | 66.7 | 78 | zinc-trasporting ATPase (Zn(II))-translocating p-type ATPase |
| 3285 | 6785 | 3174066 | 3174380 | 315 | | | | | | |
| 3286 | 6786 | 3174990 | 3174784 | 207 | | | | | | |
| 3287 | 6787 | 3175027 | 3176901 | 1875 | sp: ATZN_ECOLI | *Escherichia coli* K12 MG1655 atzN | 39.8 | 68.5 | 606 | zinc-trasporting ATPase (Zn(II))-translocating p-type ATPase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3288 | 6788 | 3175643 | 3175254 | 390 | PIR: E72491 | Aeropyrum pernix K1 APE2572 | 45.0 | 54.0 | 72 | hypothetical protein |
| 3289 | 6789 | 3171174 | 3177482 | 309 | | | 58.0 | 73.0 | 73 | transposase |
| 3290 | 6790 | 3177304 | 3177089 | 216 | GPU: AF164956_8 | Corynebacterium glutamicum Tnp1673 | 75.0 | 77.0 | 70 | transposase |
| 3291 | 6791 | 3177565 | 3177308 | 258 | GPU: AF164956_8 | Corynebacterium glutamicum Tnp1673 | 92.5 | 96.2 | 53 | transposase (IS1628) |
| 3292 | 6792 | 3177683 | 3177525 | 159 | gp: AF121000_8 | Corynebacterium glutamicum 22243 R-plasmid pAG1 tnpB | 39.0 | 74.0 | 100 | thioredoxin |
| 3293 | 6793 | 3178558 | 3178112 | 447 | sp: THI2_ECOLI | Escherichia coli K12 thi2 | 27.1 | 60.1 | 421 | transmembrane transport protein or 4-hydroxybenzoate transporter |
| 3294 | 6794 | 3178609 | 3178872 | 264 | | | | | | |
| 3295 | 6795 | 3179049 | 3180392 | 1344 | sp: PCAK_PSEPU | Pseudomonas putida pcaK | | | | |
| 3296 | 6796 | 3181104 | 3180946 | 159 | | | | | | |
| 3297 | 6797 | 3181126 | 3180551 | 576 | sp: YQJI_ECOLI | Escherichia coli K12 yqjI | 35.1 | 62.5 | 208 | hypothetical protein |
| 3298 | 6798 | 3182866 | 3181337 | 1530 | sp: DNAB_ECOLI | Escherichia coli K12 dnaB | 37.7 | 73.1 | 461 | replicative DNA helicase |
| 3299 | 6799 | 3183469 | 3183984 | 516 | | | | | | |
| 3300 | 6800 | 3183927 | 3183478 | 450 | sp: RL9_ECOLI | Escherichia coli K12 RL9 | 42.2 | 71.4 | 154 | 50S ribosomal protein L9 |
| 3301 | 6801 | 3184661 | 3183987 | 675 | sp: SSB_ECOLI | Escherichia coli K12 ssb | 30.6 | 51.5 | 229 | single-strand DNA binding protein |
| 3302 | 6802 | 3184985 | 3184701 | 285 | sp: RS6_ECOLI | Escherichia coli K12 RS6 | 28.3 | 78.3 | 92 | 30S ribosomal protein S6 |
| 3303 | 6803 | 3185536 | 3185348 | 189 | | | | | | |
| 3304 | 6804 | 3186993 | 3185536 | 1458 | gp: AF187306_1 | Mycobacterium smegmatis mc(2)155 | 41.5 | 68.3 | 480 | hypothetical protein |
| 3305 | 6805 | 3187912 | 3188793 | 882 | sp: PBPA_BACSU | Bacillus subtilis ponA | 29.1 | 60.1 | 647 | penicillin-binding protein |
| 3306 | 6806 | 3189201 | 3187042 | 2160 | sp: Y0HC_MYCTU | Mycobacterium tuberculosis H37Rv Rv0049 | 41.1 | 72.0 | 107 | hypothetical protein |
| 3307 | 6807 | 3189652 | 3189296 | 357 | | | | | | |
| 3308 | 6808 | 3189877 | 3190347 | 471 | pir: B70912 | Mycobacterium tuberculosis H37Rv Rv0042c | 35.1 | 65.0 | 137 | bacterial regulatory protein, marR family |
| 3309 | 6809 | 3190378 | 3191319 | 942 | sp: Y0FF_MYCTU | Mycobacterium tuberculosis H37Rv Rv2319c yofF | 29.7 | 61.8 | 296 | hypothetical protein |
| 3310 | 6810 | 3191354 | 3191848 | 495 | sp: YHGC_BACSU | Bacillus subtilis yhgC | 32.4 | 70.4 | 71 | hypothetical protein |
| 3311 | 6811 | 3191922 | 3192242 | 321 | sp: YCEA_ECOLI | Escherichia coli K12 yceA | 30.2 | 63.8 | 298 | hypothetical protein |
| 3312 | 6812 | 3193201 | 3192266 | 936 | sp: YBIZ_ECOLI | Escherichia coli K12 ybiZ | 31.2 | 64.0 | 433 | ABC transporter ATP-binding protein |
| 3313 | 6813 | 3194514 | 3193252 | 1263 | sp: YBIZ_ECOLI | Escherichia coli K12 ybiZ | 48.9 | 80.1 | 221 | ABC transporter ATP-binding protein |
| 3314 | 6814 | 3195203 | 3194514 | 690 | | Escherichia coli K12 MG1655 ybiZ | | | | |
| 3315 | 6815 | 3197186 | 3195210 | 1977 | pir: E81408 | Campylobacter jejuni Cj0606 | 18.0 | 42.0 | 237 | hypothetical protein |
| 3316 | 6816 | 3197412 | 3198500 | 1089 | pir: F70912 | Mycobacterium tuberculosis H37Rv Rv0046c | 77.8 | 90.0 | 360 | hypothetical protein |
| 3317 | 6817 | 3199187 | 3198582 | 606 | | | | | | |
| 3318 | 6818 | 3200686 | 3199202 | 1485 | | | | | | |
| 3319 | 6819 | 3201754 | 3201260 | 495 | sp: DPS_ECOLI | Escherichia coli K12 dps | 37.7 | 64.9 | 154 | DNA protection during starvation protein |
| 3320 | 6820 | 3201900 | 3202712 | 813 | sp: FPG_ECOLI | Escherichia coli K12 mutM or fpg | 28.4 | 55.6 | 268 | formamidopyrimidine-DNA glycosylase |
| 3321 | 6821 | 3202952 | 3204100 | 1149 | sp: RTCB_ECOLI | Escherichia coli K12 rtcB | 47.5 | 66.6 | 404 | hypothetical protein |
| 3322 | 6822 | 3204067 | 3202979 | 1089 | | | | | | |
| 3323 | 6823 | 3204156 | 3204728 | 573 | | | | | | |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3324 | 6824 | 3205204 | 3204731 | 474 | sp: MGMT_HUMAN | Homo sapiens mgmT | 38.0 | 63.3 | 166 | methylated-DNA—protein-cysteine S-methyltransferase |
| 3325 | 6825 | 3206232 | 3205222 | 1011 | sp: QOR_CAVPO | Cavia porcellus (Guinea pig) qor | 33.3 | 63.6 | 231 | zinc-binding dehydrogenase or quinone oxidoreductase (NADPH: quinone reductase) or alginate lyase |
| 3326 | 6826 | 3206646 | 3206756 | 111 | | | | | | membrane transport protein |
| 3327 | 6827 | 3206849 | 3208024 | 1176 | sp: YDEA_ECOLI | Mycobacterium tuberculosis H37Rv Rv0191 ydeA | 26.4 | 66.3 | 398 | |
| 3328 | 6828 | 3208279 | 3209454 | 1176 | gp: AF234535_1 | Corynebacterium melassecola (Corynebacterium glutamicum) ATCC 17965 malE | 99.7 | 99.5 | 392 | malate oxidoreductase [NAD] (malic enzyme) |
| 3329 | 6829 | 3211186 | 3211186 | 1482 | sp: GNTK_BACSU | Bacillus subtilis gntK | 24.5 | 53.7 | 486 | gluconokinase or gluconate kinase |
| 3330 | 6830 | 3211836 | 3211246 | 591 | sp: VANZ_ENTFC | Enterococcus faecium vanZ | 27.8 | 60.4 | 169 | teicoplanin resistance protein |
| 3331 | 6831 | 3212428 | 3211904 | 525 | sp: VANZ_ENTFC | Enterococcus faecium vanZ | 27.0 | 159.0 | 159 | teicoplanin resistance protein |
| 3332 | 6832 | 3212588 | 3213931 | 1344 | sp: MERA_STAAU | Staphylococcus aureus merA | 29.9 | 65.6 | 448 | mercury(II) reductase |
| 3333 | 6833 | 3215163 | 3213934 | 1230 | sp: DADA_ECOLI | Escherichia coli K12 dadA | 27.3 | 54.5 | 444 | D-amino acid dehydrogenase small subunit |
| 3334 | 6834 | 3216759 | 3215257 | 1503 | | | | | | |
| 3335 | 6835 | 3217215 | 3216886 | 330 | | | | | | |
| 3336 | 6836 | 3217777 | 3217457 | 321 | | | | | | |
| 3337 | 6837 | 3217993 | 3218601 | 609 | sp: NOX_THETH | Thermus thermophilus nox | 25.8 | 55.2 | 194 | NAD(P)H nitroreductase |
| 3338 | 6838 | 3218777 | 3219700 | 924 | | | | | | |
| 3339 | 6839 | 3221044 | 3222495 | 1452 | | | | | | |
| 3340 | 6840 | 3222633 | 3219778 | 2856 | sp: SYL_BACSU | Bacillus subtilis syl | 47.7 | 68.1 | 943 | leucyl-tRNA synthetase |
| 3341 | 6841 | 3222722 | 3223150 | 429 | sp: YBAN_ECOLI | Escherichia coli K12 | 40.4 | 40.4 | 104 | hypothetical membrane protein |
| 3342 | 6842 | 3223445 | 3223089 | 357 | sp: VAPI_BACNO | Dichelobacter nodosus vapI | 55.8 | 81.4 | 86 | virulence-associated protein |
| 3343 | 6843 | 3224601 | 3225374 | 774 | | | | | | |
| 3344 | 6844 | 3224714 | 3223992 | 723 | gp: SCC54_19 | Streptomyces coelicolor SCC54.19 | 31.6 | 53.8 | 247 | hypothetical protein |
| 3345 | 6845 | 3225554 | 3224718 | 837 | sp: HPCE_ECOLI | Escherichia coli K12 hpcE | 28.5 | 50.3 | 298 | bifunctional protein (homoprotocatechuate catabolism bifunctional isomerase/decarboxylase) (2-hydroxyhepta-2,4-diene-1,7-dioate isomerase and 5-carboxymethyl-2-oxo-hex-3-ene-1,7dioate decarboxylase) |
| 3346 | 6846 | 3226687 | 3225563 | 1125 | gp: AF173167_1 | Pseudomonas alcaligenes xlnE | 34.2 | 64.3 | 339 | gentisate 1,2-dioxygenase or 1-hydroxy-2-naphthoate dioxygenase |
| 3347 | 6847 | 3227689 | 3226910 | 780 | sp: KDGR_ERWCH | Pectobacterium chrysanthemi kdgR | 25.3 | 60.7 | 229 | bacterial regulatory protein, lacI family or pectin degradation repressor protein |
| 3348 | 6848 | 3227724 | 3229079 | 1356 | sp: PCAK_PSEPU | Pseudomonas putida pcaK | 27.5 | 60.8 | 454 | transmembrane transport protein or 4-hydroxybenzoate transporter |
| 3349 | 6849 | 3229119 | 3230444 | 1326 | prf: 1706191A | Pseudomonas putida | 28.2 | 49.4 | 476 | salicylate hydroxylase |
| 3350 | 6850 | 3232304 | 3231054 | 1251 | sp: EAT2_HUMAN | Homo sapiens eat2 | 25.4 | 54.4 | 507 | proton/glutamate symporter or excitatory amino acid transporter2 |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3351 | 6851 | 3232596 | 3233105 | 510 | pir: JC2326 | *Corynebacterium glutamicum* AS019 ORF1 | 99.4 | 99.4 | 170 | tryptophan-specific permease |
| 3352 | 6852 | 3233403 | 3234956 | 1554 | sp: TRPE_BRELA | *Brevibacterium lactofermentum* trpE | 99.2 | 99.8 | 515 | anthranilate synthase component I |
| 3353 | 6853 | 3233420 | 3233250 | 171 | | | | | | |
| 3354 | 6854 | 3234956 | 3235579 | 624 | TRPG_BRELA | *Brevibacterium lactofermentum* trpG | 99.0 | 100.0 | 208 | anthranilate synthase component II |
| 3355 | 6855 | 3235602 | 3236645 | 1044 | sp: TRPD_CORGL | *Corynebacterium glutamicum* ATCC 21850 trpD | 99.4 | 99.4 | 348 | anthranilate phosphoribosyltransferase |
| 3356 | 6856 | 3236641 | 3238062 | 1422 | sp: TRPC_BRELA | *Brevibacterium lactofermentum* trpC | 97.3 | 98.3 | 474 | indole-3-glycerol phosphate synthase (IGPS) and N-(5′-phosphoribosyl) anthranilate isomerase(PRAI) |
| 3357 | 6857 | 3237213 | 3236518 | 696 | | | | | | |
| 3358 | 6858 | 3238082 | 3239332 | 1251 | sp: TRPB_BRELA | *Brevibacterium lactofermentum* trpB | 97.6 | 97.9 | 417 | tryptophan synthase beta chain |
| 3359 | 6859 | 3239332 | 3240171 | 840 | sp: TRPA_BRELA | *Brevibacterium lactofermentum* trpA | 95.4 | 96.5 | 283 | tryptophan synthase alpha chain |
| 3360 | 6860 | 3241851 | 3240313 | 1539 | gp: SCJ21_17 | *Streptomyces coelicolor* A3(2) SCJ21.17c | 66.6 | 86.8 | 521 | hypothetical membrane protein |
| 3361 | 6861 | 3242688 | 3241879 | 810 | sp: PTXA_ECOLI | *Escherichia coli* K12 ptxA | 30.3 | 71.7 | 152 | PTS system, IIA component or unknown pentitol phosphotransferase enzyme II, A component |
| 3362 | 6862 | 3242854 | 3243759 | 906 | sp: NOSF_PSEST | *Pseudomonas stutzeri* | 32.5 | 63.6 | 305 | ABC transporter ATP-binding protein |
| 3363 | 6863 | 3243759 | 3245342 | 1584 | gp: SCH10_12 | *Streptomyces coelicolor* A3(2) SCH10.12 | 25.2 | 57.2 | 547 | ABC transporter |
| 3364 | 6864 | 3245317 | 3245766 | 450 | sp: UCRL_CHLLI | *Chlorobium limicola* petC | 32.5 | 63.6 | 305 | cytchrome b6-F complex iron-sulfur subunit (Rieske iron-sulfur protein) |
| 3365 | 6865 | 3246931 | 3245822 | 1110 | sp: NADO_THEBR | *Thermoanaerobacter brockii* nadO | 33.3 | 64.3 | 336 | NADH oxidase or NADH-dependent flavin oxidoreductase |
| 3366 | 6866 | 3247234 | 3248205 | 972 | sp: YFEH_ECOLI | *Escherichia coli* K12 yfeH | 43.6 | 74.7 | 328 | hypothetical membrane protein |
| 3367 | 6867 | 3248392 | 3249165 | 774 | gp: SCI11_36 | *Streptomyces coelicolor* A3(2) SCI11.36c | 34.0 | 54.6 | 262 | hypothetical protein |
| 3368 | 6868 | 3249534 | 3249187 | 348 | pir: A29606 | *Streptomyces coelicolor* Plasmid SCP1 mmr | 45.1 | 79.4 | 102 | bacterial regulatory protein, arsR family or methylenomycin A resistance protein |
| 3369 | 6869 | 3249651 | 3250742 | 1092 | sp: NADO_THEBR | *Thermoanaerobacter brockii* nadO | 33.4 | 64.3 | 347 | NADH oxidase or NADH-dependent flavin oxidoreductase |
| 3370 | 6870 | 3250758 | 3251405 | 648 | sp: YMY0_YEAST | *Saccharomyces cerevisiae* ymyO | 31.4 | 69.5 | 226 | hypothetical protein |
| 3371 | 6871 | 3251618 | 3251466 | 153 | | | | | | |
| 3372 | 6872 | 3251934 | 3251743 | 192 | | | | | | |
| 3373 | 6873 | 3252300 | 3252133 | 168 | | | | | | |
| 3374 | 6874 | 3252636 | 3252316 | 321 | | | | | | |
| 3375 | 6875 | 3252728 | 3253480 | 753 | sp: BUDC_KLETE | *Klebsiella terrigena* budC | 26.9 | 52.9 | 238 | acetoin(diacetyl) reductase (acetoin dehydrogenase) |
| 3376 | 6876 | 3253560 | 3253739 | 180 | sp: YY34_MYCTU | *Mycobacterium tuberculosis* H37Rv Rv2094c | 53.5 | 84.5 | 58 | hypothetical protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3377 | 6877 | 3255182 | 3253824 | 1359 | sp: DTPT_LACLA | Lactococcus lactis subsp. lactis dtpT | 34.5 | 71.6 | 469 | di-/tripeptide transpoter |
| 3378 | 6878 | 3255549 | 3255719 | 171 | sp: ACRR_ECOLI | Escherichia coli K12 acrR | 26.1 | 50.5 | 188 | bacterial regulatory protein, tetR family |
| 3379 | 6879 | 3256298 | 3255744 | 555 | | | | | | |
| 3380 | 6880 | 3257373 | 3256471 | 903 | sp: CATA_ACICA | Acinetobacter calcoaceticus catA | 31.7 | 62.2 | 246 | hydroxyquinol 1,2-dioxygenase |
| 3381 | 6881 | 3258491 | 3257403 | 1089 | sp: TCBF_PSESQ | Pseudomonas sp. P51 | 43.0 | 75.5 | 351 | maleylacetate reductase |
| 3382 | 6882 | 3260084 | 3258561 | 1524 | sp: XYLE_ECOLI | Escherichia coli K12 xylE | 31.4 | 58.3 | 513 | sugar transporter or D-xylose-proton symporter (D-xylose transporter) |
| 3383 | 6883 | 3261129 | 3261989 | 861 | sp: ICLR_SALTY | Salmonella typhimurium iclR | 25.7 | 60.7 | 280 | bacterial transcriptional regulator or acetate operon repressor |
| 3384 | 6884 | 3262145 | 3263221 | 1077 | sp: YDGJ_ECOLI | Escherichia coli K12 ydgJ | 27.2 | 55.7 | 357 | oxidoreductase |
| 3385 | 6885 | 3263237 | 3264115 | 879 | gsp: W61761 | Listeria innocua strain 4450 | 25.9 | 58.2 | 270 | diagnostic fragment protein sequence |
| 3386 | 6886 | 3264142 | 3265146 | 1005 | sp: MI2D_BACSU | SinoRhizobium meliloti idhA | 26.5 | 59.6 | 332 | myo-inositol 2-dehydrogenase |
| 3387 | 6887 | 3265184 | 3266266 | 1083 | sp: STRI_STRGR | Streptomyces griseus strI | 34.1 | 62.4 | 343 | dehydrogenase or myo-inositol 2-dehydrogenase or streptomycin biosynthesis protein |
| 3388 | 6888 | 3267062 | 3271093 | 4032 | pir: C70044 | Bacillus subtilis yvnB | 33.3 | 62.7 | 1242 | phosphoesterase |
| 3389 | 6889 | 3268557 | 3267913 | 645 | | | | | | |
| 3390 | 6890 | 3269235 | 3268618 | 618 | | | | | | |
| 3391 | 6891 | 3271392 | 3272477 | 1086 | | | | | | |
| 3392 | 6892 | 3275231 | 3274488 | 744 | sp: UNC1_CAEEL | Caenorhabditis elegans unc1 | 28.6 | 57.3 | 206 | stomatin |
| 3393 | 6893 | 3276570 | 3275602 | 969 | gp: MBO18605_3 | Mycobacterium bovis BCG RvD1-Rv2024c | 58.4 | 80.2 | 1660 | DEAD box RNA helicase family |
| 3394 | 6894 | 3281599 | 3276671 | 4929 | prf: 2323363AAM | Mycobacterium leprae u2266k | 34.8 | 61.0 | 141 | hypothetical membrane protein |
| 3395 | 6895 | 3282172 | 3281666 | 507 | sp: THID_BACSU | Bacillus subtilis thiD | 50.4 | 76.8 | 125 | phosphomethylpyrimidine kinase |
| 3396 | 6896 | 3282742 | 3283101 | 360 | sp: F70041 | Bacillus subtilis yvgY | 46.3 | 70.1 | 67 | mercuric ion-binding protein or heavy-metal-associated domain containing protein |
| 3397 | 6897 | 3282946 | 3282347 | 600 | | | | | | |
| 3398 | 6898 | 3283141 | 3283383 | 243 | | | | | | |
| 3399 | 6899 | 3284309 | 3283473 | 837 | prf: 2501295A | Corynebacterium glutamicum proP | 29.9 | 62.3 | 297 | ectoine/proline uptake protein |
| 3400 | 6900 | 3285355 | 3284399 | 957 | sp: FECB_ECOLI | Escherichia coli K12 fecB | 29.4 | 60.6 | 279 | iron(III) dicitrate-binding periplasmic protein precursor or iron(III) dicitrate transport system permease protein |
| 3401 | 6901 | 3285455 | 3286576 | 1122 | sp: MRF1_SCHPO | Schizosaccharomyces pombe mrf1 | 27.2 | 58.0 | 324 | mitochondrial respiratory function protein or zinc-binding dehydrogenase or NADPH quinone oxidoreductase |
| 3402 | 6902 | 3286622 | 3287005 | 384 | | | | | | |
| 3403 | 6903 | 3287297 | 3287079 | 219 | | | | | | |
| 3404 | 6904 | 3288190 | 3287393 | 798 | sp: THID_BACSU | Bacillus subtilis thiD | 46.2 | 75.5 | 249 | phosphomethylpyrimidine kinase |
| 3405 | 6905 | 3288265 | 3288609 | 345 | | | | | | |
| 3406 | 6906 | 3288685 | 3288885 | 201 | pir: F70041 | Bacillus subtilis yvgY | 41.8 | 70.1 | 67 | mercuric ion-binding protein or heavy-metal-associated domain containing protein |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3407 | 6907 | 3289315 | 3288971 | 345 | sp: AZLD_BACSU | *Bacillus subtilis* azlD | 36.3 | 65.7 | 102 | branched-chain amino acid transport |
| 3408 | 6908 | 3290021 | 3289311 | 711 | sp: AZLC_BACSU | *Bacillus subtilis* azlD | 32.1 | 67.0 | 212 | branched-chain amino acid transport |
| 3409 | 6909 | 3290591 | 3290025 | 567 | sp: YQGE_ECOLI | *Escherichia coli* K12 yqgE | 23.7 | 56.2 | 169 | hypothetical protein |
| 3410 | 6910 | 3291942 | 3290623 | 1320 | sp: CCA_ECOLI | *Escherichia coli* K12 cca | 26.8 | 51.8 | 471 | tRNA nucleotidyltransferase |
| 3411 | 6911 | 3292532 | 3293497 | 966 | pir: E70600 | *Mycobacterium tuberculosis* H37Rv Rv3908 | 43.6 | 69.2 | 234 | mutator mutT protein |
| 3412 | 6912 | 3292882 | 3292610 | 273 | | | | | | |
| 3413 | 6913 | 3293497 | 3296007 | 2511 | pir: F70600 | *Mycobacterium tuberculosis* H37Rv Rv3909 | 25.8 | 54.3 | 858 | hypothetical membrane protein |
| 3414 | 6914 | 3296156 | 3299404 | 3249 | pir: G70600 | *Mycobacterium tuberculosis* H37Rv Rv3910 | 35.7 | 60.1 | 1201 | hypothetical membrane protein |
| 3415 | 6915 | 3297706 | 3298428 | 723 | sp: RPSH_PSEAE | *Pseudomonas aeruginosa* algU | 30.2 | 60.9 | 189 | RNA polymerase sigma-H factor or sigma-70 factor (ECF subfamily) |
| 3416 | 6916 | 3299661 | 3300263 | 603 | sp: TRXB_STRCL | *Streptomyces clavuligerus* trxB | 60.4 | 82.5 | 308 | thioredoxin reductase |
| 3417 | 6917 | 3300371 | 3301321 | 951 | sp: THI2_CHLRE | *Chlamydomonas reinhardtii* thi2 | 42.0 | 76.5 | 119 | thioredoxin ch2, M-type |
| 3418 | 6918 | 3301303 | 3300119 | 1185 | sp: CWLB_BACSU | *Bacillus subtilis* cwlB | 51.0 | 75.4 | 196 | N-acetylmuramoyl-L-alanine amidase |
| 3419 | 6919 | 3301358 | 3301729 | 372 | | | | | | |
| 3420 | 6920 | 3301755 | 3302996 | 1242 | | | | | | |
| 3421 | 6921 | 3302765 | 3301989 | 777 | | | | | | |
| 3422 | 6922 | 3303435 | 3304475 | 1041 | | | | | | |
| 3423 | 6923 | 3303616 | 3302999 | 618 | pir: D70851 | *Mycobacterium tuberculosis* H37Rv Rv3916c | 34.4 | 58.5 | 212 | hypothetical protein |
| 3424 | 6924 | 3304787 | 3303636 | 1152 | sp: YGI2_PSEPU | *Pseudomonas putida* ygi2 | 37.6 | 60.5 | 367 | hypothetical protein |
| 3425 | 6925 | 3305671 | 3304835 | 837 | sp: YGI1_PSEPU | *Mycobacterium tuberculosis* H37Rv parB | 65.0 | 78.0 | 272 | partitioning or sporulation protein |
| 3426 | 6926 | 3306532 | 3305864 | 669 | sp: GIDB_ECOLI | *Escherichia coli* K12 gidB | 36.0 | 64.7 | 153 | glucose inhibited division protein B |
| 3427 | 6927 | 3307632 | 3306682 | 951 | pir: A70852 | *Mycobacterium tuberculosis* H37Rv Rv3921c | 44.7 | 75.4 | 313 | hypothetical membrane protein |
| 3428 | 6928 | 3308369 | 3307971 | 399 | sp: RNPA_BACSU | *Bacillus subtilis* rnpA | 26.8 | 59.4 | 123 | ribonuclease P protein component |
| 3429 | 6929 | 3308747 | 3308412 | 336 | gp: MAU19185_1 | *Mycobacterium avium* rpmH | 83.0 | 93.6 | 47 | 50S ribosomal protein L34 |
| 3430 | 6930 | 3309028 | 3309321 | 294 | | | | | | |
| 3431 | 6931 | 3309043 | 3308822 | 222 | | | | | | |
| 3432 | 6932 | 147980 | 147573 | 408 | gp: AF116184_1 | *Corynebacterium glutamicum* panD | 100.0 | 100.0 | 136 | L-aspartate-alpha-decarboxylase precursor |
| 3433 | 6933 | 268001 | 266154 | 1848 | sp: LEU1_CORGL | *Corynebacterium glutamicum* ATCC 13032 leuA | 100.0 | 100.0 | 616 | 2-isopropylmalate synthase |
| 3434 | 6934 | 269068 | 268814 | 255 | sp: YLEU_CORGL | *Corynebacterium glutamicum* (*Brevibacterium flavum*) ATCC 13032 orfX | 100.0 | 100.0 | 85 | hypothetical protein |
| 3435 | 6935 | 270660 | 271691 | 1032 | sp: DHAS_CORGL | *Corynebacterium glutamicum* asd | 100.0 | 100.0 | 344 | aspartate-semialdehyde dehydrogenase |
| 3436 | 6936 | 446075 | 446521 | 447 | gp: AF124518_1 | *Corynebacterium glutamicum* ASO19 aroD | 100.0 | 100.0 | 149 | 3-dehydroquinase |
| 3437 | 6937 | 526376 | 527563 | 1188 | sp: EFTU_CORGL | *Corynebacterium glutamicum* ATCC 13059 tuf | 100.0 | 100.0 | 396 | elongation factor Tu |
| 3438 | 6938 | 569452 | 570771 | 1320 | sp: SECY_CORGL | *Corynebacterium glutamicum* (*Brevibacterium flavum*) MJ233 secY | 100.0 | 100.0 | 440 | preprotein translocase secY subuit |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3439 | 6939 | 680044 | 677831 | 2214 | sp: IDH_CORGL | Corynebacterium glutamicum ATCC 13032 icd | 100.0 | 100.0 | 738 | isocitrate dehydrogenase (oxalosuccinatedecarboxylase) |
| 3440 | 6940 | 720352 | 718580 | 1773 | prf: 2223173A | Corynebacterium glutamicum ATCC 13032 accBC | 100.0 | 100.0 | 591 | acyl-CoA carboxylase or biotin-binding protein |
| 3441 | 6941 | 877838 | 879148 | 1311 | sp: CISY_CORGL | Corynebacterium glutamicum ATCC 13032 gltA | 100.0 | 100.0 | 437 | citrate synthase |
| 3442 | 6942 | 879276 | 879629 | 354 | sp: FKBP_CORGL | Corynebacterium glutamicum ATCC 13032 fkbA | 100.0 | 100.0 | 118 | putative binding protein or peptidyl-prolyl cis-trans isomerase |
| 3443 | 6943 | 944996 | 946780 | 1785 | sp: BETP_CORGL | Corynebacterium glutamicum ATCC 13032 betP | 100.0 | 100.0 | 595 | glycine betaine transporter |
| 3444 | 6944 | 1030283 | 1029006 | 1278 | sp: YLI2_CORGL | Corynebacterium glutamicum ATCC 13032 orf2 | 100.0 | 100.0 | 426 | hypothetical membrane protein |
| 3445 | 6945 | 1031871 | 1030369 | 1503 | sp: LYSI_CORGL | Corynebacterium glutamicum ATCC 13032 lysI | 100.0 | 100.0 | 501 | L-lysine permease |
| 3446 | 6946 | 1154683 | 1153295 | 1389 | sp: AROP_CORGL | Corynebacterium glutamicum ATCC 13032 aroP | 100.0 | 100.0 | 463 | aromatic amino acid permease |
| 3447 | 6947 | 1155676 | 1154729 | 948 | pir: S52753 | Corynebacterium glutamicum ATCC 13032 orf3 | 100.0 | 100.0 | 316 | hypothetical protein |
| 3448 | 6948 | 1155731 | 1156837 | 1107 | prf: 2106301A | Corynebacterium glutamicum ATCC 13032 dapE | 100.0 | 100.0 | 369 | succinyl diaminopimelate |
| 3449 | 6949 | 1219602 | 1218031 | 1572 | gp: CGPUTP_1 | Corynebacterium glutamicum ATCC 13032 putP | 100.0 | 100.0 | 524 | proline transport system |
| 3450 | 6950 | 1238274 | 1239923 | 1650 | sp: SYR_CORGL | Corynebacterium glutamicum AS019 ATCC 13059 argS | 100.0 | 100.0 | 550 | arginyl-tRNA synthetase |
| 3451 | 6951 | 1239929 | 1241263 | 1335 | sp: DCDA_CORGL | Corynebacterium glutamicum AS019 ATCC 13059 lysA | 100.0 | 100.0 | 445 | diaminopimelate (DAP) decarboxylase (meso-diaminopimelate decarboxylase) |
| 3452 | 6952 | 1242507 | 1243841 | 1335 | sp: DHOM_CORGL | Corynebacterium glutamicum AS019 ATCC 13059 hom | 100.0 | 100.0 | 445 | homoserine dehydrogenase |
| 3453 | 6953 | 1243855 | 1244781 | 927 | sp: KHSE_CORGL | Corynebacterium glutamicum AS019 ATCC 13059 thrB | 100.0 | 100.0 | 309 | homoserine kinase |
| 3454 | 6954 | 1327617 | 1328243 | 627 | gsp: W37716 | Corynebacterium glutamicum R127 orf3 | 100.0 | 100.0 | 216 | ion channel subunit |
| 3455 | 6955 | 1328953 | 1328246 | 708 | sp: LYSE_CORGL | Corynebacterium glutamicum R127 lysE | 100.0 | 100.0 | 236 | lysine exporter protein |
| 3456 | 6956 | 1329015 | 1329884 | 870 | sp: LYSG_CORGL | Corynebacterium glutamicum R127 lysG | 100.0 | 100.0 | 290 | lysine export regulator protein |
| 3457 | 6957 | 1338131 | 1340008 | 1878 | sp: ILVB_CORGL | Corynebacterium glutamicum ATCC 13032 ilvB | 100.0 | 100.0 | 626 | acetohydroxy acid synthase, large subunit |
| 3458 | 6958 | 1340025 | 1340540 | 516 | pir: B48648 | Corynebacterium glutamicum ATCC 13032 ilvN | 100.0 | 100.0 | 172 | acetohydroxy acid synthase, small subunit |
| 3459 | 6959 | 1340724 | 1341737 | 1014 | pir: C48648 | Corynebacterium glutamicum ATCC 13032 ilvC | 100.0 | 100.0 | 338 | acetohydroxy acid isomeroreductase |
| 3460 | 6960 | 1353489 | 1354508 | 1020 | sp: LEU3_CORGL | Corynebacterium glutamicum ATCC 13032 leuB | 100.0 | 100.0 | 340 | 3-isopropylmalate dehydrogenase |
| 3461 | 6961 | 1423217 | 1425265 | 2049 | prf: 2014259A | Corynebacterium glutamicum KCTC1445 ptsM | 100.0 | 100.0 | 683 | PTS system, phosphoenolpyruvate sugar phosphotransferase (mannose and glucose transport) |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3462 | 6962 | 1466491 | 1467372 | 882 | sp: ARGB_CORGL | Corynebacterium glutamicum ATCC 13032 argB | 100.0 | 100.0 | 294 | acetylglutamate kinase |
| 3463 | 6963 | 1468565 | 1469521 | 957 | sp: OTCA_CORGL | Corynebacterium glutamicum ATCC 13032 argF | 100.0 | 100.0 | 319 | ornithine carbamoyltransferase |
| 3464 | 6964 | 1469528 | 1470040 | 513 | gp: AF041436_1 | Corynebacterium glutamicum AS019 argR | 100.0 | 100.0 | 171 | arginine repressor |
| 3465 | 6965 | 1544554 | 1543154 | 1401 | gp: CGL238250_1 | Corynebacterium glutamicum ATCC 13032 ndh | 100.0 | 100.0 | 467 | NADH dehydrogenase |
| 3466 | 6966 | 1586725 | 1586465 | 261 | gp: AF086704_1 | Corynebacterium glutamicum AS019 hisE | 100.0 | 100.0 | 87 | phosphoribosyl-ATP-pyrophosphohydrolase |
| 3467 | 6967 | 1675208 | 1674123 | 1086 | gp: CGL007732_4 | Corynebacterium glutamicum ATCC 13032 ocd | 100.0 | 100.0 | 362 | ornithine-cyclodecarboxylase |
| 3468 | 6968 | 1676623 | 1675268 | 1356 | gp: CGL007732_3 | Corynebacterium glutamicum ATCC 13032 amt | 100.0 | 100.0 | 452 | ammonium uptake protein, high affinity |
| 3469 | 6969 | 1677279 | 1677049 | 231 | gp: CGL007732_2 | Corynebacterium glutamicum ATCC 13032 secG | 100.0 | 100.0 | 77 | protein-export membrane protein secG |
| 3470 | 6970 | 1680143 | 1677387 | 2757 | prf: 1509267A | Corynebacterium glutamicum ATCC 13032 ppc | 100.0 | 100.0 | 919 | phosphoenolpyruvate carboxylase |
| 3471 | 6971 | 1720898 | 1719669 | 1230 | gp: AF124600_1 | Corynebacterium glutamicum AS019 aroC | 100.0 | 100.0 | 410 | chorismate synthase (5-enolpyruvylshikimate-3-phosphate phospholyase) |
| 3472 | 6972 | 1880490 | 1882385 | 1896 | pir: B55225 | Corynebacterium glutamicum ATCC 13032 cglIIR | 100.0 | 100.0 | 632 | restriction endonuclease |
| 3473 | 6973 | 2020854 | 2021846 | 993 | prf: 2204286D | Corynebacterium glutamicum ATCC 13869 sigB | 100.0 | 100.0 | 331 | sigma factor or RNA polymerase transcription factor |
| 3474 | 6974 | 2060620 | 2061504 | 885 | sp: GLUB_CORGL | Corynebacterium glutamicum ATCC 13032 gluB | 100.0 | 100.0 | 295 | glutamate-binding protein |
| 3475 | 6975 | 2065116 | 2063989 | 1128 | sp: RECA_CORGL | Corynebacterium glutamicum AS019 recA | 100.0 | 100.0 | 376 | recA protein |
| 3476 | 6976 | 2080183 | 2079281 | 903 | sp: DAPA_BRELA | Corynebacterium glutamicum (Brevibacterium lactofermentum) ATCC 13869 dapA | 100.0 | 100.0 | 301 | dihydrodipicolinate synthase |
| 3477 | 6977 | 2081934 | 2081191 | 744 | sp: DAPB_CORGL | Corynebacterium glutamicum (Brevibacterium lactofermentum) ATCC 13869 dapB | 100.0 | 100.0 | 248 | dihydrodipicolinate reductase |
| 3478 | 6978 | 2115363 | 2113864 | 1500 | gp: CGA224946_1 | Corynebacterium glutamicum R127 mqo | 100.0 | 100.0 | 500 | L-malate dehydrogenase (acceptor) |
| 3479 | 6979 | 2171741 | 2169666 | 2076 | gp: CAJ10319_4 | Corynebacterium glutamicum ATCC 13032 glnD | 100.0 | 100.0 | 692 | uridilyltransferase, uridilyl-removing enzyme |
| 3480 | 6980 | 2172086 | 2171751 | 336 | gp: CAJ10319_3 | Corynebacterium glutamicum ATCC 13032 glnB | 100.0 | 100.0 | 112 | nitrogen regulatory protein P-II |
| 3481 | 6981 | 2173467 | 2172154 | 1314 | gp: CAJ10319_2 | Corynebacterium glutamicum ATCC 13032 amtP | 100.0 | 100.0 | 438 | ammonium transporter |
| 3482 | 6982 | 2196082 | 2194742 | 1341 | pir: S32227 | Corynebacterium glutamicum ATCC 17965 gdhA | 100.0 | 100.0 | 447 | glutamate dehydrogenase (NADP+) |
| 3483 | 6983 | 2207092 | 2205668 | 1425 | sp: KPYK_CORGL | Corynebacterium glutamicum AS019 pyk | 100.0 | 100.0 | 475 | pyruvate kinase |

TABLE 1-continued

| SEQ NO. (DNA) | SEQ NO. (a.a.) | Initial (nt) | Terminal (nt) | ORF (bp) | db Match | Homologous gene | Identity (%) | Similarity (%) | Matched length (a.a.) | Function |
|---|---|---|---|---|---|---|---|---|---|---|
| 3484 | 6984 | 2317550 | 2316582 | 969 | gp: AF096280_1 | Corynebacterium glutamicum ATCC 13032 glk | 100.0 | 100.0 | 323 | glucokinase |
| 3485 | 6985 | 2348829 | 2350259 | 1431 | prf: 2322244A | Corynebacterium glutamicum ATCC 13032 glnA | 100.0 | 100.0 | 477 | glutamine synthetase |
| 3486 | 6986 | 2355042 | 2353600 | 1443 | sp: THRC_CORGL | Corynebacterium glutamicum thrC | 100.0 | 100.0 | 481 | threonine synthase |
| 3487 | 6987 | 2450172 | 2448328 | 1845 | prf: 2501295B | Corynebacterium glutamicum ATCC 13032 ectP | 100.0 | 100.0 | 615 | ectoine/proline/glycine betaine carrier |
| 3488 | 6988 | 2470141 | 2467925 | 2217 | pir: I40715 | Corynebacterium glutamicum ATCC 13032 aceB | 100.0 | 100.0 | 739 | malate synthase |
| 3489 | 6989 | 2470740 | 2472035 | 1296 | pir: I40713 | Corynebacterium glutamicum ATCC 13032 aceA | 100.0 | 100.0 | 432 | isocitrate lyase |
| 3490 | 6990 | 2497776 | 2496670 | 1107 | sp: PROB_CORGL | Corynebacterium glutamicum ATCC 17965 proB | 100.0 | 100.0 | 369 | glutamate 5-kinase |
| 3491 | 6991 | 2591469 | 2590312 | 1158 | gp: AF126953_1 | Corynebacterium glutamicum ASO19 metB | 100.0 | 100.0 | 386 | cystathionine gamma-synthase |
| 3492 | 6992 | 2680127 | 2679684 | 444 | gp: AF112535_2 | Corynebacterium glutamicum ATCC 13032 nrdI | 100.0 | 100.0 | 148 | ribonucleotide reductase |
| 3493 | 6993 | 2680649 | 2680419 | 231 | gp: AF112535_1 | Corynebacterium glutamicum ATCC 13032 nrdH | 100.0 | 100.0 | 77 | glutaredoxin |
| 3494 | 6994 | 2787715 | 2786756 | 960 | sp: DDH_CORGL | Corynebacterium glutamicum KY10755 ddh | 100.0 | 100.0 | 320 | meso-diaminopimelate D-dehydrogenase |
| 3495 | 6995 | 2888078 | 2887944 | 135 | gp: CGL238703_1 | Corynebacterium glutamicum MH20-22B porA | 100.0 | 100.0 | 45 | porin or cell wall channel forming protein |
| 3496 | 6996 | 2936505 | 2935315 | 1191 | sp: ACKA_CORGL | Corynebacterium glutamicum ATCC 13032 ackA | 100.0 | 100.0 | 397 | acetate kinase |
| 3497 | 6997 | 2937494 | 2936508 | 987 | prf: 2516394A | Corynebacterium glutamicum ATCC 13032 pta | 100.0 | 100.0 | 329 | phosphate acetyltransferase |
| 3498 | 6998 | 2961342 | 2962718 | 1377 | prf: 2309322A | Corynebacterium glutamicum ATCC 13032 cmr | 100.0 | 100.0 | 459 | multidrug resistance protein or macrolide-efflux pump or drug: proton antiporter |
| 3499 | 6999 | 2966161 | 2963606 | 2556 | sp: CLPB_CORGL | Corynebacterium glutamicum ATCC 13032 clpB | 100.0 | 100.0 | 852 | ATP-dependent protease regulatory subunit |
| 3500 | 7000 | 3099522 | 3098578 | 945 | prf: 1210266A | Corynebacterium glutamicum pheA | 100.0 | 100.0 | 315 | prephenate dehydratase |
| 3501 | 7001 | 3274074 | 3272563 | 1512 | prf: 2501295A | Corynebacterium glutamicum ATCC 13032 proP | 100.0 | 100.0 | 504 | ectoine/proline uptake protein |

EXAMPLE 2

Determination of Effective Mutation Site (1) Identification of Mutation Site Based on the Comparison of the Gene Nucleotide Sequence of Lysine-Producing B-6 Strain with that of Wild Type Strain ATCC 13032

Corynebacterium glutamicum B-6, which is resistant to S-(2-aminoethyl)cysteine (AEC), rifampicin, streptomycin and 6-azauracil, is a lysine-producing mutant having been mutated and bred by subjecting the wild type ATCC 13032 strain to multiple rounds of random mutagenesis with a mutagen, N-methyl-N'-nitro-N-nitrosoguanidine (NTG) and screening (*Appl. Microbiol. Biotechnol.*, 32: 269-273 (1989)). First, the nucleotide sequences of genes derived from the B-6 strain and considered to relate to the lysine production were determined by a method similar to the above. The genes relating to the lysine production include lysE and lysG which are lysine-excreting genes; ddh, dapA, hom and lysC (encoding diaminopimelate dehydrogenase, dihydropicolinate synthase, homoserine dehydrogenase and aspartokinase, respectively) which are lysine-biosynthetic genes; and pyc and zwf (encoding pyruvate carboxylase and glucose-6-phosphate dehydrogenase, respectively) which are glucose-metabolizing genes. The nucleotide sequences of the genes derived from the production strain were compared with the corresponding nucleotide sequences of the ATCC 13032 strain genome represented by SEQ ID NOS:1 to 3501 and analyzed. As a result, mutation points were observed in many genes. For example, no mutation site was observed in lysE, lysG, ddh, dapA, and the like, whereas amino acid replacement mutations were found in hom, lysC, pyc, zwf, and the like. Among these mutation points, those which are considered to contribute to the production were extracted on the basis of known biochemical or genetic information. Among the mutation points thus extracted, a mutation, Val59Ala, in hom and a mutation, Pro458Ser, in pyc were evaluated whether or not the mutations were effective according to the following method.

(2) Evaluation of Mutation, Val59Ala, in hom and Mutation, Pro458Ser, in pyc

It is known that a mutation in horn inducing requirement or partial requirement for homoserine imparts lysine productivity to a wild type strain (*Amino Acid Fermentation*, ed. by Hiroshi Aida et al., Japan Scientific Societies Press). However, the relationship between the mutation, Val59Ala, in hom and lysine production is not known. It can be examined whether or not the mutation, Val59Ala, in hom is an effective mutation by introducing the mutation to the wild type strain and examining the lysine productivity of the resulting strain. On the other hand, it can be examined whether or not the mutation, Pro458Ser, in pyc is effective by introducing this mutation into a lysine-producing strain which has a deregulated lysine-bioxynthetic pathway and is free from the pyc mutation, and comparing the lysine productivity of the resulting strain with the parent strain. As such a lysine-producing bacterium, No. 58 strain (FERM BP-7134) was selected (hereinafter referred to the "lysine-producing No. 58 strain" or the "No. 58 strain"). Based on the above, it was determined that the mutation, Val59Ala, in hom and the mutation, Pro458Ser, in pyc were introduced into the wild type strain of *Corynebacterium glutamicum* ATCC 13032 (hereinafter referred to as the "wild type ATCC 13032 strain" or the "ATCC 13032 strain") and the lysine-producing No. 58 strain, respectively, using the gene replacement method. A plasmid vector pCES30 for the gene replacement for the introduction was constructed by the following method.

A plasmid vector pCE53 having a kanamycin-resistant gene and being capable of autonomously replicating in Coryneform bacteria (*Mol. Gen. Genet.*, 196: 175-178 (1984)) and a plasmid pMOB3 (ATCC 77282) containing a levansucrase gene (sacB) of *Bacillus subtilis* (*Molecular Microbiology*, 6: 1195-1204 (1992)) were each digested with PstI. Then, after agarose gel electrophoresis, a pCE53 fragment and a 2.6 kb DNA fragment containing sacB were each extracted and purified using GENECLEAN Kit (manufactured by BIO 101). The pCE53 fragment and the 2.6 kb DNA fragment were ligated using Ligation Kit ver. 2 (manufactured by Takara Shuzo), introduced into the ATCC 13032 strain by the electroporation method (*FEMS Microbiology Letters*, 65: 299 (1989)), and cultured on BYG agar medium (medium prepared by adding 10 g of glucose, 20 g of peptone (manufactured by Kyokuto Pharmaceutical), 5 g of yeast extract (manufactured by Difco), and 16 g of Bactoagar (manufactured by Difco) to 1 liter of water, and adjusting its pH to 7.2) containing 25 µg/ml kanamycin at 30° C. for 2 days to obtain a transformant acquiring kanamycin-resistance. As a result of digestion analysis with restriction enzymes, it was confirmed that a plasmid extracted from the resulting transformant by the alkali SDS method had a structure in which the 2.6 kb DNA fragment had been inserted into the PstI site of pCE53. This plasmid was named pCES30.

Next, two genes having a mutation point, hom and pyc, were amplified by PCR, and inserted into pCES30 according to the TA cloning method (Bio Experiment Illustrated vol. 3, published by Shujunsha). Specifically, pCES30 was digested with BamHI (manufactured by Takara Shuzo), subjected to an agarose gel electrophoresis, and extracted and purified using GENECLEAN Kit (manufactured by BIO 101). The both ends of the resulting pCES30 fragment were blunted with DNA Blunting Kit (manufactured by Takara Shuzo) according to the attached protocol. The blunt-ended pCES30 fragment was concentrated by extraction with phenol/chloroform and precipitation with ethanol, and allowed to react in the presence of Taq polymerase (manufactured by Roche Diagnostics) and dTTP at 70° C. for 2 hours so that a nucleotide, thymine (T), was added to the 3'-end to prepare a T vector of pCES30.

Separately, chromosomal DNA was prepared from the lysine-producing B-6 strain according to the method of Saito et al. (*Biochem. Biophys. Acta*, 72: 619 (1963)). Using the chromosomal DNA as a template, PCR was carried out with Pfu turbo DNA polymelase (manufactured by Stratagene). In the mutated hom gene, the DNAs having the nucleotide sequences represented by SEQ ID NOS:7002 and 7003 were used as the primer set. In the mutated pyc gene, the DNAs having the nucleotide sequences represented by SEQ ID NOS:7004 and 7005 were used as the primer set. The resulting PCR product was subjected to agarose gel electrophoresis, and extracted and purified using GENEGLEAN Kit (manufactured by BIO 101). Then, the PCR product was allowed to react in the presence of Taq polymerase (manufactured by Roche Diagnostics) and dATP at 72° C. for 10 minutes so that a nucleotide, adenine (A), was added to the 3'-end.

The above pCES30 T vector fragment and the mutated hom gene (1.7 kb) or mutated pyc gene (3.6 kb) to which the nucleotide A had been added of the PCR product were concentrated by extraction with phenol/chloroform and precipitation with ethanol, and then ligated using Ligation Kit ver. 2. The ligation products were introduced into the ATCC 13032 strain according to the electroporation method, and cultured on BYG agar medium containing 25 μg/ml kanamycin at 30° C. for 2 days to obtain kanamycin-resistant transformants. Each of the resulting transformants was cultured overnight in BYG liquid medium containing 25 μg/ml kanamycin, and a plasmid was extracted from the culturing solution medium according to the alkali SDS method. As a result of digestion analysis using restriction enzymes, it was confirmed that the plasmid had a structure in which the 1.7 kb or 3.6 kb DNA fragment had been inserted into pCES30. The plasmids thus constructed were named respectively pChom59 and pCpyc458.

The introduction of the mutations to the wild type ATCC 13032 strain and the lysine-producing No. 58 strain according to the gene replacement method was carried out according to the following method. Specifically, pChom59 and pCpyc458 were introduced to the ATCC 13032 strain and the No. 58 strain, respectively, and strains in which the plasmid is integrated into the chromosomal DNA by homologous recombination were selected using the method of Ikeda et al. (*Microbiology* 144: 1863 (1998)). Then, the stains in which the second homologous recombination was carried out were selected by a selection method, making use of the fact that the *Bacillus subtilis* levansucrase encoded by pCES30 produced a suicidal substance (*J. of Bacteriol.*, 174: 5462 (1992)). Among the selected strains, strains in which the wild type hom and pyc genes possessed by the ATCC 13032 strain and the No. 58 strain were replaced with the mutated hom and pyc genes, respectively, were isolated. The method is specifically explained below.

One strain was selected from the transformants containing the plasmid, pChom59 or pCpyc458, and the selected strain was cultured in BYG medium containing 20 μg/ml kanamycin, and pCG11 (Japanese Published Examined Patent Application No. 91827/94) was introduced thereinto by the electroporation method. pCG11 is a plasmid vector having a spectinomycin-resistant gene and a replication origin which is the same as pCE53. After introduction of the pCG11, the strain was cultured on BYG agar medium containing 20 μg/ml kanamycin and 100 μg/ml spectinomycin at 30° C. for 2 days to obtain both the kanamycin- and spectinomycin-resistant transformant. The chromosome of one strain of these transformants was examined by the Southern blotting hybridization according to the method reported by Ikeda et al. (*Microbiology*, 144: 1863 (1998)). As a result, it was confirmed that pChom59 or pCpyc458 had been integrated into the chromosome by the homologous recombination of the Cambell type. In such a strain, the wild type and mutated hom or pyc genes are present closely on the chromosome, and the second homologous recombination is liable to arise therebetween.

Each of these transformants (having been recombined once) was spread on Suc agar medium (medium prepared by adding 100 g of sucrose, 7 g of meat extract, 10 g of peptone, 3 g of sodium chloride, 5 g of yeast extract (manufactured by Difco), and 18 g of Bactoagar (manufactured by Difco) to 1 liter of water, and adjusting its pH 7.2) and cultured at 30° C. for a day. Then the colonies thus growing were selected in each case. Since a strain in which the sacb gene is present converts sucrose into a suicide substrate, it cannot grow in this medium (*J. Bacteriol.*, 174: 5462 (1992)). On the other hand, a strain in which the sacB gene was deleted due to the second homologous recombination between the wild type and the mutated hom or pyc genes positioned closely to each other forms no suicide substrate and, therefore, can grow in this medium. In the homologous recombination, either the wild type gene or the mutated gene is deleted together with the sacB gene. When the wild type is deleted together with the sacb gene, the gene replacement into the mutated type arises.

Chromosomal DNA of each the thus obtained second recombinants was prepared by the above method of Saito et al. PCR was carried out using Pfu turbo DNA polymerase (manufactured by Stratagene) and the attached buffer. In the hom gene, DNAs having the nucleotide sequences represented by SEQ ID NOS:7002 and 7003 were used as the primer set. Also, in the pyc gene was used, DNAs having the nucleotide sequences represented by SEQ ID NOS:7004 and 7005 were used as the primer set. The nucleotide sequences of the PCR products were determined by the conventional method so that it was judged whether the hom or pyc gene of the second recombinant was a wild type or a mutant. As a result, the second recombinant which were called HD-1 and No. 58pyc were target strains having the mutated hom gene and pyc gene, respectively.

(3) Lysine Production Test of HD-1 and No. 58pyc Strains

The HD-1 strain (strain obtained by incorporating the mutation, Val59Ala, in the hom gene into the ATCC 13032 strain) and the No. 58pyc strain (strain obtained by incorporating the mutation, Pro458Ser, in the pyc gene into the lysine-producing No. 58 strain) were subjected to a culture test in a 5 l jar fermenter by using the ATCC 13032 strain and the lysine-producing No. 58 strain respectively as a control. Thus lysine production was examined.

After culturing on BYG agar medium at 30° C. for 24 hours, each strain was inoculated into 250 ml of a seed medium (medium prepared by adding 50 g of sucrose, 40 g of corn steep liquor, 8.3 g of ammonium sulfate, 1 g of urea, 2 g of potassium dihydrogenphosphate, 0.83 g of magnesium sulfate heptahydrate, 10 mg of iron sulfate heptahydrate, 1 mg of copper sulfate pentahydrate, 10 mg of zinc sulfate hentahydrate, 10 mg of β-alanine, 5 mg of nicotinic acid, 1.5 mg of thiamin hydrochloride, and 0.5 mg of biotin to 1 liter of water, and adjusting its pH to 7.2, then to which 30 g of calcium carbonate had been added) contained in a 2 l buffle-attached Erlenmeyer flask and cultured therein at 30° C. for 12 to 16 hours. A total amount of the seed culturing medium was inoculated into 1,400 ml of a main culture medium (medium prepared by adding 60 g of glucose, 20 g of corn steep liquor, 25 g of ammonium chloride, 2.5 g of potassium dihydrogenphosphate, 0.75 g of magnesium sulfate heptahydrate, 50 mg of iron sulfate heptahydrate, 13 mg of manganese sulfate pentahydrate, 50 mg of calcium chloride, 6.3 mg of copper sulfate pentahydrate, 1.3 mg of zinc sulfate heptahydrate, 5 mg of nickel chloride hexahydrate, 1.3 mg of cobalt chloride hexahydrate, 1.3 mg of ammonium molybdenate tetrahydrate, 14 mg of nicotinic acid, 23 mg of β-alanine, 7 mg of thiamin hydrochloride, and 0.42 mg of biotin to 1 liter of water) contained in a 5 l jar fermenter and cultured therein at 32° C., 1 vvm and 800 rpm while controlling the pH to 7.0 with aqueous ammonia. When glucose in the medium had been consumed, a glucose feeding solution (medium prepared by adding 400 g glucose and 45 g of ammonium chloride to 1 liter of water) was continuously added. The addition of feeding solution was carried out at a controlled speed so as to maintain the dissolved oxygen concentration within a range of 0.5 to 3 ppm After culturing for 29 hours, the culture was terminated. The cells were separated from the culture medium by centrifugation and then L-lysine hydrochloride in the supernatant was quantified by high performance liquid chromatography (HPLC). The results are shown in Table 2 below.

TABLE 2

| Strain | L-Lysine hydrochloride yield (g/l) |
|---|---|
| ATCC 13032 | 0 |
| HD-1 | 8 |
| No. 58 | 45 |
| No. 58pyc | 51 |

As is apparent from the results shown in Table 2, the lysine productivity was improved by introducing the mutation, Val59Ala, in the hom gene or the mutation, Pro458Ser, in the pyc gene. Accordingly, it was found that the mutations are both effective mutations relating to the production of lysine. Strain, AHP-3, in which the mutation, Val59Ala, in the hom gene and the mutation, Pro458Ser, in the pyc gene have been introduced into the wild type ATCC 13032 strain together with the mutation, Thr331Ile in the lysC gene has been deposited on Dec. 5, 2000, in National Institute of Bioscience and Human Technology, Agency of Industrial Science and Technology (Higashi 1-1-3, Tsukuba-shi, Ibaraki, Japan) as FERM BP-7382.

EXAMPLE 3

Reconstruction of Lysine-Producing Strain Based on Genome Information

The lysine-producing mutant B-6 strain (*Appl. Microbiol. Biotechnol.*, 32: 269-273 (1989)), which has been constructed by multiple round random mutagenesis with NTG and screening from the wild type ATCC 13032 strain, produces-a remarkably large amount of lysine hydrochloride when cultured in a jar at 32° C. using glucose as a carbon source. However, since the fermentation period is long, the production rate is less than 2.1 g/l/h. Breeding to reconstitute only effective mutations relating to the production of lysine among the estimated at least 300 mutations introduced into the B-6 strain in the wild type ATCC 13032 strain was performed.

(1) Identification of Mutation Point and Effective Mutation by Comparing the Gene Nucleotide Sequence of the B-6 Strain with that of the ATCC 13032 Strain As described above, the nucleotide sequences of genes derived from the B-6 strain were compared with the corresponding nucleotide sequences of the ATCC 13032 strain genome represented by SEQ ID NOS:1 to 3501 and analyzed to identify many mutation points accumulated in the chromosome of the B-6 strain. Among these, a mutation, Val591Ala, in hom, a mutation, Thr311Ile, in lysC, a mutation, Pro458Ser, in pyc and a mutation, Ala213Thr, in zwf were specified as effective mutations relating to the production of lysine. Breeding to reconstitute the 4 mutations in the wild type strain and for constructing of an industrially important lysine-producing strain was carried out according to the method shown below.

(2) Construction of Plasmid for Gene Replacement Having Mutated Gene

The plasmid for gene replacement, pChom59, having the mutated hom gene and the plasmid for gene replacement, pCpyc458, having the mutated pyc gene were prepared in the above Example 2(2). Plasmids for gene replacement having the mutated lysC and zwf were produced as described below.

The lysC and zwf having mutation points were amplified by PCR, and inserted into a plasmid for gene replacement, pCES30, according to the TA cloning method described in Example 2(2) (Bio Experiment Illustrated, Vol. 3).

Separately, chromosomal DNA was prepared from the lysine-producing B-6 strain according to the above method of Saito et al. Using the chromosomal DNA as a template, PCR was carried out with Pfu turbo DNA polymerase (manufactured by Stratagene). In the mutated lysC gene, the DNAs having the nucleotide sequences represented by SEQ ID NOS:7006 and 7007 were used as the primer set. In the mutated zwf gene, the DNAs having the nucleotide sequences represented by SEQ ID NOS:7008 and 7009 as the primer set. The resulting PCR product was subjected to agarose gel electrophoresis, and extracted and purified using GENEGLEAN Kit (manufactured by BIO 101). Then, the PCR product was allowed to react in the presence of Taq DNA polymerase (manufactured by Roche Diagnostics) and dATP at 72° C. for 10 minutes so that a nucleotide, adenine (A), was added to the 3'-end.

The above pCES30 T vector fragment and the mutated lysC gene (1.5 kb) or mutated zwf gene (2.3 kb) to which the nucleotide A had been added of the PCR product were concentrated by extraction with phenol/chloroform and precipitation with ethanol, and then ligated using Ligation Kit ver. 2. The ligation products were introduced into the ATCC 13032 strain according to the electroporation method, and cultured on BYG agar medium containing 25 μg/ml kanamycin at 30° C. for 2 days to obtain kanamycin-resistant transformants. Each of the resulting transformants was cultured overnight in BYG liquid medium containing 25 μg/ml kanamycin, and a plasmid was extracted from the culturing solution medium according to the alkali SDS method. As a result of digestion analysis using restriction enzymes, it was confirmed that the plasmid had a structure in which the 1.5 kb or 2.3 kb DNA fragment had been inserted into pCES30. The plasmids thus constructed were named respectively pClysC311 and pCzwf213.

(3) Introduction of Mutation, Thr311Ile, in lysC into One Point Mutant HD-1

Since the one mutation point mutant HD-1 in which the mutation, Val59Ala, in hom was introduced into the wild type ATCC 13032 strain had been obtained in Example 2(2), the mutation, Thr311Ile, in lysC was introduced into the HD-1 strain using pClysC311 produced in the above (2) according to the gene replacement method described in Example 2(2). PCR was carried out using chromosomal DNA of the resulting strain and, as the primer set, DNAs having the nucleotide sequences represented by SEQ ID NOS:7006 and 7007 in the same manner as in Example 2(2). As a result of the fact that the nucleotide sequence of the PCR product was determined in the usual manner, it was confirmed that the strain which was named AHD-2 was a two point mutant having the mutated lysC gene in addition to the mutated hom gene.

(4) Introduction of Mutation, Pro458Ser, in pyc into Two Point Mutant AHD-2

The mutation, Pro458Ser, in pyc was introduced into the AHD-2 strain using the pCpyc458 produced in Example 2(2) by the gene replacement method described in Example 2(2). PCR was carried out using chromosomal DNA of the resulting strain and, as the primer set, DNAs having the nucleotide sequences represented by SEQ ID NOS:7004 and 7005 in the same manner as in Example 2(2). As a result of the fact that the nucleotide sequence of the PCR product was determined in the usual manner, it was confirmed that the strain which was named AHD-3 was a three point mutant having the mutated pyc gene in addition to the mutated hom gene and lysC gene.

(5) Introduction of Mutation, Ala213Thr, in zwf into Three Point Mutant AHP-3

The mutation, Ala213Thr, in zwf was introduced into the AHP-3 strain using the pCzwf458 produced in the above (2) by the gene replacement method described in Example 2(2). PCR was carried out using chromosomal DNA of the resulting strain and, as the primer set, DNAs having the nucleotide sequences represented by SEQ ID NOS:7008 and 7009 in the same manner as in Example 2(2). As a result of the fact that the nucleotide sequence of the PCR product was determined in the usual manner, it was confirmed that the strain which was named APZ-4 was a four point mutant having the mutated zwf gene in addition to the mutated hom gene, lysC gene and pyc gene.

(6) Lysine Production Test on HD-1, AHD-2, AHP-3 and APZ-4 Strains

The HD-1, AHD-2, AHP-3 and APZ-4 strains obtained above were subjected to a culture test in a 5 l jar fermenter in accordance with the method of Example 2(3).

Table 3 shows the results.

TABLE 3

| Strain | L-Lysine hydrochloride (g/l) | Productivity (g/l/h) |
| --- | --- | --- |
| HD-1 | 8 | 0.3 |
| AHD-2 | 73 | 2.5 |
| AHP-3 | 80 | 2.8 |
| APZ-4 | 86 | 3.0 |

Since the lysine-producing mutant B-6 strain which has been bred based on the random mutation and selection shows a productivity of less than 2.1 g/l/h, the APZ-4 strain showing a high productivity of 3.0 g/l/h is useful in industry.

(7) Lysine Fermentation by APZ-4 Strain at High Temperature

The APZ-4 strain, which had been reconstructed by introducing 4 effective mutations into the wild type strain, was subjected to the culturing test in a 5 l jar fermenter in the same manner as in Example 2(3), except that the culturing temperature was changed to 40° C.

The results are shown in Table 4.

TABLE 4

| Temperature (° C.) | L-Lysine hydrochloride (g/l) | Productivity (g/l/h) |
| --- | --- | --- |
| 32 | 86 | 3.0 |
| 40 | 95 | 3.3 |

As is apparent from the results shown in Table 4, the lysine hydrochloride titer and productivity in culturing at a high temperature of 40° C. comparable to those at 32° C. were obtained. In the mutated and bred lysine-producing B-6 strain constructed by repeating random mutation and selection, the growth and the lysine productivity are lowered at temperatures exceeding 34° C. so that lysine fermentation cannot be carried out, whereas lysine fermentation can be carried out using the APZ-4 strain at a high temperature of 40° C. so that the load of cooling is greatly reduced and it is industrially useful. The lysine fermentation at high temperatures can be achieved by reflecting the high temperature adaptability inherently possessed by the wild type strain on the APZ-4 strain.

As demonstrated in the reconstruction of the lysine-producing strain, the present invention provides a novel breeding method effective for eliminating the problems in the conventional mutants and acquiring industrially advantageous strains. This methodology which reconstitutes the production strain by reconstituting the effective mutation is an approach which is efficiently carried out using the nucleotide sequence information of the genome disclosed in the present invention, and its effectiveness was found for the first time in the present invention.

EXAMPLE 4

Production of DNA Microarray and use thereof

A DNA microarray was produced based on the nucleotide sequence information of the ORF deduced from the full nucleotide sequences of *Corynebacterium glutamicum* ATCC 13032 using software, and genes of which expression is fluctuated depending on the carbon source during culturing were searched.

(1) Production of DNA Microarray

Chromosomal DNA was prepared from *Corynebacterium glutamicum* ATCC 13032 by the method of Saito et al. (*Biochem. Biophys. Acta,* 72: 619 (1963)). Based on 24 genes having the nucleotide sequences represented by SEQ ID NOS:207, 3433, 281, 3435, 3439, 765, 3445, 1226, 1229, 3448, 3451, 3453, 3455, 1743, 3470, 2132, 3476, 3477, 3485, 3488, 3489, 3494, 3496, and 3497 from the ORFs shown in Table 1 deduced from the full genome nucleotide sequence of *Corynebacterium glutamicum* ATCC 13032 using software and the nucleotide sequence of rabbit globin gene (GenBank Accession No. V00882) used as an internal standard, oligo DNA primers for PCR amplification represented by SEQ ID NOS:7010 to 7059 targeting the nucleotide sequences of the genes were synthesized in a usual manner.

As the oligo DNA primers used for the PCR,

DNAs having the nucleotide sequence represented by SEQ ID NOS:7010 and 7011 were used for the amplification of the DNA having the nucleotide sequence represented by SEQ ID NO:207, DNAs having the nucleotide sequence represented by SEQ ID NOS:7012 and 7013 were used for the amplification of the DNA having the nucleotide sequence represented by SEQ ID NO:3433, DNAs having the nucleotide sequence represented by SEQ ID NOS:7014 and 7015 were used for the amplification of the DNA having the nucleotide sequence represented by SEQ ID NO:281, DNAs having the nucleotide sequence represented by SEQ ID NOS:7016 and 7017 were used for the amplification of the DNA having the nucleotide sequence represented by SEQ ID NO:3435, DNAs having the nucleotide sequence represented by SEQ ID NOS:7018 and 7019 were used for the amplification of the DNA having the nucleotide sequence represented by SEQ ID NO:3439, DNAs having the nucleotide sequence represented by SEQ ID NOS:7020 and 7021 were used for the amplification of the DNA having the nucleotide sequence represented by SEQ ID NO:765, DNAs having the nucleotide sequence represented by SEQ ID NOS:7022 and 7023 were used for the amplification of the DNA having the nucleotide sequence represented by SEQ ID NO:3445, DNAs having the nucleotide sequence represented by SEQ ID NOS:7024 and 7025 were used for the amplification of the DNA having the nucleotide sequence represented by SEQ ID NO:1226, DNAs having the nucleotide sequence represented by SEQ ID NOS:7026 and 7027 were used for the amplification of the DNA having the nucleotide sequence represented by SEQ ID NO:1229, DNAs having the nucleotide sequence represented by SEQ ID NOS:7028 and 7029 were used for the amplification of the DNA having the nucleotide sequence represented by SEQ ID NO:3448, DNAs having the nucleotide sequence represented by SEQ ID NOS:7030 and 7031 were used for the amplification of the DNA having the nucleotide sequence represented by SEQ ID NO:3451, DNAs having the nucleotide sequence represented by SEQ ID NOS:7032 and 7033 were used for the amplification of the DNA having the nucleotide sequence represented by SEQ ID NO:3453, DNAs having the nucleotide sequence represented by SEQ ID NOS:7034 and 7035 were used for the amplification of the DNA having the nucleotide sequence represented by SEQ ID NO:3455, DNAs having the nucleotide sequence represented by SEQ ID NOS:7036 and 7037 were used for the amplification of the DNA having the nucleotide sequence represented by SEQ ID NO:1743, DNAs having the nucleotide sequence represented by SEQ ID NOS:7038 and 7039 were used for the amplification of the DNA having the nucleotide sequence represented by SEQ ID NO:3470, DNAs having the nucleotide sequence represented by SEQ ID NOS:7040 and 7041 were used for the amplification of the DNA having the nucleotide sequence represented by SEQ ID NO:2132, DNAs having the nucleotide sequence represented by SEQ ID NOS:7042 and 7043 were used for the amplification of the DNA having the nucleotide sequence represented by SEQ ID NO:3476, DNAs having the nucleotide sequence represented by SEQ ID NOS:7044 and 7045 were used for the amplification of the DNA having the nucleotide sequence represented by SEQ ID NO:3477, DNAs having the nucleotide sequence represented by SEQ ID NOS:7046 and 7047 were used for the amplification of the DNA having the nucleotide sequence represented by SEQ ID NO:3485, DNAs having the nucleotide sequence represented by SEQ ID NOS:7048 and 7049 were used for the amplification of the DNA having the nucleotide sequence represented by SEQ ID NO:3488, DNAs having the nucleotide sequence represented by SEQ ID NOS:7050 and 7051 were used for the amplification of the DNA having the nucleotide sequence represented by SEQ ID NO:3489, DNAs having the nucleotide sequence represented by SEQ ID NOS:7052 and 7053 were used for the amplification of the DNA having the nucleotide sequence represented by SEQ ID NO:3494, DNAs having the nucleotide sequence represented by SEQ ID NOS:7054 and 7055 were used for the amplification of the DNA having the nucleotide sequence represented by SEQ ID NO:3496, DNAs having the nucleotide sequence represented by SEQ ID NOS:7056 and 7057 were used for the amplification of the DNA having the nucleotide sequence represented by SEQ ID NO:3497, and DNAs having the nucleotide sequence represented by SEQ ID NOS:7058 and 7059 were used for the amplification of the DNA having the nucleotide sequence of the rabbit globin gene, as the respective primer set.

The PCR was carried for 30 cycles with each cycle consisting of 15 seconds at 95° C. and 3 minutes at 68° C. using a thermal cycler (GeneAmp PCR system 9600, manufactured by Perkin Elmer), TaKaRa EX-Taq (manufactured by Takara Shuzo), 100 ng of the chromosomal DNA and the buffer attached to the TaKaRa Ex-Taq reagent. In the case of the rabbit globin gene, a single-stranded cDNA which had been synthesized from rabbit globin mRNA (manufactured by Life Technologies) according to the manufacture's instructions using a reverse transcriptase RAV-2 (manufactured by Takara Shuzo). The PCR product of each gene thus amplified was subjected to agarose gel electrophoresis and extracted and purified using QIAquick Gel Extraction Kit (manufactured by QIAGEN). The purified PCR product was concentrated by precipitating it with ethanol and adjusted to a concentration of 200 ng/µl. Each PCR product was spotted on a slide glass plate (manufactured by Matsunami Glass) having MAS coating in 2 runs using GTMASS SYSTEM (manufactured by Nippon Laser & Electronics Lab.) according to the manufacture's instructions.

(2) Synthesis of Fluorescence Labeled cDNA

The ATCC 13032 strain was spread on BY agar medium (medium prepared by adding 20 g of peptone (manufactured by Kyokuto Pharmaceutical), 5 g of yeast extract (manufactured by Difco), and 16 g of Bactoagar (manufactured by Difco) to in 1 liter of water and adjusting its pH to 7.2) and cultured at 30° C. for 2 days. Then, the cultured strain was further inoculated into 5 ml of BY liquid medium and cultured at 30° C. overnight. Then, the cultured strain was further inoculated into 30 ml of a minimum medium (medium prepared by adding 5 g of ammonium sulfate, 5 g of urea, 0.5 g of monopotassium dihydrogenphosphate, 0.5 g of dipotassium monohydrogenphosphate, 20.9 g of morpholinopropanesulfonic acid, 0.25 g of magnesium sulfate heptahydrate, 10 mg of calcium chloride dihydrate, 10 mg of manganese sulfate monohydrate, 10 mg of ferrous sulfate heptahydrate, 1 mg of zinc sulfate heptahydrate, 0.2 mg copper sulfate, and 0.2 mg biotin to 1 liter of water, and adjusting its pH to 6.5) containing 110 mmol/l glucose or 200 mmol/l ammonium acetate, and cultured in an Erlenmyer flask at 30° to give 1.0 of absorbance at 660 nm. After the cells were prepared by centrifuging at 4° C. and 5,000 rpm for 10 minutes, total RNA was prepared from the resulting cells according to the method of Bormann et al. (*Molecular Microbiology*, 6: 317-326 (1992)). To avoid contamination with DNA, the RNA was treated with DnaseI (manufactured by Takara Shuzo) at 37° C. for 30 minutes and then further purified using Qiagen RNeasy MiniKit (manufactured by QIAGEN) according to the manufacture's instructions. To 30 μg of the resulting total RNA, 0.6 μl of rabbit globin mRNA (50 ng/μl, manufactured by Life Technologies) and 1 μl of a random 6 mer primer (500 ng/μl, manufactured by Takara Shuzo) were added for denaturing at 65° C. for 10 minutes, followed by quenching on ice. To the resulting solution, 6 μl of a buffer attached to SuperScript II (manufactured by Lifetechnologies), 3 μl of 0.1 mol/l DTT, 1.5 μl of dNTPs (25 mmol/l dATP, 25 mmol/l dCTP, 25 mmol/l dGTP, 10 mmol/l dTTP), 1.5 μl of Cy5-dUTP or Cy3-dUTP (manufactured by NEN) and 2 μl of SuperScript II were added, and allowed to stand at 25° C. for 10 minutes and then at 42° C. for 110 minutes. The RNA extracted from the cells using glucose as the carbon source and the RNA extracted from the cells using ammonium acetate were labeled with Cy5-dUTP and Cy3-dUTP, respectively. After the fluorescence labeling reaction, the RNA was digested by adding 1.5 μl of 1 mol/l sodium hydroxide-20 mmol/l EDTA solution and 3.0 μl of 10% SDS solution, and allowed to stand at 65° C. for 10 minutes. The two cDNA solutions after the labeling were mixed and purified using Qiagen PCR purification Kit (manufactured by QIAGEN) according to the manufacture's instructions to give a volume of 10 μl.

(3) Hybridization

UltraHyb (110 μl) (manufactured by Ambion) and the fluorescence-labeled cDNA solution (10 μl) were mixed and subjected to hybridization and the subsequent washing of slide glass using GeneTAC Hybridization Station (manufactured by Genomic Solutions) according to the manufacture's instructions. The hybridization was carried out at 50° C., and the washing was carried out at 25° C.

(4) Fluorescence Analysis

The fluorescence amount of each DNA array having the fluorescent cDNA hybridized therewith was measured using ScanArray 4000 (manufactured by GSI Lumonics).

Table 5 shows the Cy3 and Cy5 signal intensities of the genes having been corrected on the basis of the data of the rabbit globin used as the internal standard and the Cy3/Cy5 ratios.

TABLE 5

| SEQ ID NO | Cy3 intensity | Cy5 intensity | Cy3/Cy5 |
|---|---|---|---|
| 207 | 5248 | 3240 | 1.62 |
| 3433 | 2239 | 2694 | 0.83 |
| 281 | 2370 | 2595 | 0.91 |
| 3435 | 2566 | 2515 | 1.02 |
| 3439 | 5597 | 6944 | 0.81 |
| 765 | 6134 | 4943 | 1.24 |
| 3455 | 1169 | 1284 | 0.91 |
| 1226 | 1301 | 1493 | 0.87 |
| 1229 | 1168 | 1131 | 1.03 |
| 3448 | 1187 | 1594 | 0.74 |
| 3451 | 2845 | 3859 | 0.74 |
| 3453 | 3498 | 1705 | 2.05 |
| 3455 | 1491 | 1144 | 1.30 |
| 1743 | 1972 | 1841 | 1.07 |
| 3470 | 4752 | 3764 | 1.26 |

TABLE 5-continued

| SEQ ID NO | Cy3 intensity | Cy5 intensity | Cy3/Cy5 |
|---|---|---|---|
| 2132 | 1173 | 1085 | 1.08 |
| 3476 | 1847 | 1420 | 1.30 |
| 3477 | 1284 | 1164 | 1.10 |
| 3485 | 4539 | 8014 | 0.57 |
| 3488 | 34289 | 1398 | 24.52 |
| 3489 | 43645 | 1497 | 29.16 |
| 3494 | 3199 | 2503 | 1.28 |
| 3496 | 3428 | 2364 | 1.45 |
| 3497 | 3848 | 3358 | 1.15 |

The ORF function data estimated by using software were searched for SEQ ID NOS:3488 and 3489 showing remarkably strong Cy3 signals. As a result, it was found that SEQ ID NOS:3488 and 3489 are a maleate synthase gene and an isocitrate lyase gene, respectively. It is known that these genes are transcriptionally induced by acetic acid in *Corynebacterium glutamicum* (*Archives of Microbiology*, 168: 262-269 (1997)).

As described above, a gene of which expression is fluctuates could be discovered by synthesizing appropriate oligo DNA primers based on the ORF nucleotide sequence information deduced from the full genomic nucleotide sequence information of *Corynebacterium glutamicum* ATCC 13032 using software, amplifying the nucleotide sequences of the gene using the genome DNA of *Corynebacterium glutamicum* as a template in the PCR reaction, and thus producing and using a DNA microarray.

This Example shows that the expression amount can be analyzed using a DNA microarray in the 24 genes. On the other hand, the present DNA microarray techniques make it possible to prepare DNA microarrays having thereon several thousand gene probes at once. Accordingly, it is also possible to prepare DNA microarrays having thereon all of the ORF gene probes deduced from the full genomic nucleotide sequence of *Corynebacterium glutamicum* ATCC 13032 determined by the present invention, and analyze the expression profile at the total gene level of *Corynebacterium glutamicum* using these arrays.

EXAMPLE 5

Homology Search Using *Corynebacterium glutamicum* Genome Sequence (1) Search of Adenosine Deaminase The amino acid sequence (ADD_ECOLI) of *Escherichia coli* adenosine deaminase was obtained from Swiss-prot Database as the amino acid sequence of the protein of which function had been confirmed as adenosine deaminase (EC3.5.4.4). By using the full length of this amino acid sequence as a query, a homology search was carried out on a nucleotide sequence database of the genome sequence of *Corynebacterium glutamicum* or a database of the amino acids in the ORF region deduced from the genome sequence using FASTA program (*Proc. Natl. Acad. Sci. ISA*, 85: 2444-2448 (1988)). A case where E-value was $1e^{-10}$ or less was judged as being significantly homologous. As a result, no sequence significantly homologous with the *Escherichia coli* adenosine deaminase was found in the nucleotide sequence database of the genome sequence of *Corynebacterium glutamicum* or the database of the amino acid sequences in the ORF region deduced from the genome sequence. Based on these results, it is assumed that *Corynebacterium glutamicum* contains no ORF having adenosine deaminase activity and thus has no activity of converting adenosine into inosine.

(2) Search of Glycine Cleavage Enzyme

The sequences (GCSP_ECOLI, GCST_ECOLI and GCSH_ECOLI) of glycine decarboxylase, aminomethyl transferase and an aminomethyl group carrier each of which is a component of *Escherichia coli* glycine cleavage enzyme as the amino acid sequence of the protein, of which function had been confirmed as glycine cleavage enzyme (EC2.1.2.10), were obtained from Swiss-prot Database.

By using these full-length amino acid sequences as a query, a homology search was carried out on a nucleotide sequence database of the genome sequence of *Corynebacterium glutamicum* or a database of the ORF amino acid sequences deduced from the genome sequence using FASTA program. A case where E-value was $1e^{-10}$ or less was judged as being significantly homologous. As a result, no sequence significantly homologous with the glycine decarboxylase, the aminomethyl transferase or the aminomethyl group carrier each of which is a component of *Escherichia coli* glycine cleavage enzyme, was found in the nucleotide sequence database of the genome sequence of *Corynebacterium glutamicum* or the database of the ORF amino acid sequences estimated from the genome sequence. Based on these results, it is assumed that *Corynebacterium glutamicum* contains no ORF having the activity of glycine decarboxylase, aminomethyl transferase or the aminomethyl group carrier and thus has no activity of the glycine cleavage enzyme.

(3) Search of IMP Dehydrogenase

The amino acid sequence (IMDH ECOLI) of *Escherichia coli* IMP dehydrogenase as the amino acid sequence of the protein, of which function had been confirmed as IMP dehydrogenase (EC1.1.1.205), was obtained from Swiss-prot Database. By using the full length of this amino acid sequence as a query, a homology search was carried out on a nucleotide sequence database of the genome sequence of *Corynebacterium glutamicum* or a database of the ORF amino acid sequences predicted from the genome sequence using FASTA program. A case where E-value was $1e^{-10}$ or less was judged as being significantly homologous. As a result, the amino acid sequences encoded by two ORFs, namely, an ORF positioned in the region of the nucleotide sequence No. 615336 to 616853 (or ORF having the nucleotide sequence represented by SEQ ID NO:672) and another ORF positioned in the region of the nucleotide sequence No. 616973 to 618094 (or ORF having the nucleotide sequence represented by SEQ ID NO:674) were significantly homologous with the ORFs of *Escherichia coli* IMP dehydrogenase. By using the above-described predicted amino acid sequence as a query in order to examine the similarity of the amino acid sequences encoded by the ORFs with IMP dehydrogenases of other organisms in greater detail, a search was carried out on GenBank (http://www.ncbi.nlm.nih.gov/) nr-aa database (amino acid sequence database constructed on the basis of GenBankCDS translation products, PDB database, Swiss-Prot database, PIR database, PRF database by eliminating duplicated registrations) using BLAST program. As a result, both of the two amino acid sequences showed significant homologies with IMP dehydrogenases of other organisms and clearly higher homologies with IMP dehdyrogenases than with amino acid sequences of other proteins, and thus, it was assumed that the two ORFs would function as IMP dehydrogenase. Based on these results, it was therefore assumed that *Corynebacterium glutamicum* has two ORFs having the IMP dehydrogenase activity.

EXAMPLE 6

Proteome Analysis of Proteins Derived from *Corynebacterium glutamicum*

(1) Preparations of Proteins Derived from *Corynebacterium glutamicum* ATCC 13032, FERM BP-7134 and FERM BP-158

Culturing tests of *Corynebacterium glutamicum* ATCC 13032 (wild type strain), *Corynebacterium glutamicum* FERM BP-7134 (lysine-producing strain) and *Corynebacterium glutamicum* (FERM BP-158, lysine-highly producing strain) were carried out in a 5 l jar fermenter according to the method in Example 2(3). The results are shown in Table 6.

TABLE 6

| Strain | L-Lysine yield (g/l) |
| --- | --- |
| ATCC 13032 | 0 |
| FERM BP-7134 | 45 |
| FERM BP-158 | 60 |

After culturing, cells of each strain were recovered by centrifugation. These cells were washed with Tris-HCl buffer (10 mmol/l Tris-HCl, pH 6.5, 1.6 mg/ml protease inhibitor (COMPLETE; manufactured by Boehringer Mannheim)) three times to give washed cells which could be stored under freezing at −80° C. The freeze-stored cells were thawed before use, and used as washed cells.

The washed cells described above were suspended in a disruption buffer (10 mmol/l Tris-HCl, pH 7.4, 5 mmol/l magnesium chloride, 50 mg/l RNase, 1.6 mg/ml protease inhibitor (COMPLETE: manufactured by Boehringer Mannheim)), and disrupted with a disrupter (manufactured by Brown) under cooling. To the resulting disruption solution, DNase was added to give a concentration of 50 mg/l, and allowed to stand on ice for 10 minutes. The solution was centrifuged (5,000×g, 15 minutes, 4° C.) to remove the undisrupted cells as the precipitate, and the supernatant was recovered.

To the supernatant, urea was added to give a concentration of 9 mol/l, and an equivalent amount of a lysis buffer (9.5 mol/l urea, 2% NP-40, 2% Ampholine, 5% mercaptoethanol, 1.6 mg/ml protease inhibitor (COMPLETE; manufactured by Boehringer Mannheim) was added thereto, followed by thoroughly stirring at room temperature for dissolving.

After being dissolved, the solution was centrifuged at 12,000×g for 15 minutes, and the supernatant was recovered.

To the supernatant, ammonium sulfate was added to the extent of 80% saturation, followed by thoroughly stirring for dissolving.

After being dissolved, the solution was centrifuged (16,000×g, 20 minutes, 4° C.), and the precipitate was recovered. This precipitate was dissolved in the lysis buffer again and used in the subsequent procedures as a protein sample. The protein concentration of this sample was determined by the method for quantifying protein of Bradford.

(2) Separation of Protein by Two Dimensional Electrophoresis

The first dimensional electrophoresis was carried out as described below by the isoelectric electrophoresis method.

A molded dry IPG strip gel (pH 4-7, 13 cm, Immobiline DryStrips; manufactured by Amersham Pharmacia Biotech) was set in an electrophoretic apparatus (Multiphor II or IPGphor; manufactured by Amersham Pharmacia Biotech) and a swelling solution (8 mol/l urea, 0.5% Triton X-100, 0.69 dithiothreitol, 0:5% Ampholine, pH 3-10) was packed therein, and the gel was allowed to stand for swelling 12 to 16 hours.

The protein sample prepared above was dissolved in a sample solution (9 mol/l urea, 2% CRAPS, 1% dithiothreitol, 2% Ampholine, pH 3-10), and then about 100 to 500 μg (in terms of protein) portions thereof were taken and added to the swollen IPG strip gel.

The electrophoresis was carried out in the 4 steps as defined below under controlling the temperature to 20° C.:

step 1: 1 hour under a gradient mode of 0 to 500V;

step 2: 1 hour under a gradient mode of 500 to 1,000 V;

step 3: 4 hours under a gradient mode of 1,000 to 8,000 V; and step 4: 1 hour at a constant voltage of 8,000 V.

After the isoelectric electrophoresis, the IPG strip gel was put off from the holder and soaked in an equilibration buffer A (50 mmol/l Tris-HCl, pH 6.8, 30% glycerol, 1% SDS, 0.25% dithiothreitol) for 15 minutes and another equilibration buffer B (50 mmol/l Tris-HCl, pH 6.8, 6 mol/l urea, 30% glycerol, 1% SDS, 0.45% iodo acetamide) for 15 minutes to sufficiently equilibrate the gel.

After the equilibrium, the IPG strip gel was lightly rinsed in an SDS electrophoresis buffer (1.4% glycine, 0.1% SDS, 0.3% Tris-HCl, pH 8.5), and the second dimensional electrophoresis depending on molecular weight was carried out as described below to separate the proteins.

Specifically, the above IPG strip gel was closely placed on 14% polyacrylamide slub gel (14% polyacrylamide, 0.37% bisacrylamide, 37.5 mmol/l Tris-HCl, pH 8.8, 0.1% SDS, 0.1% TEMED, 0.1% ammonium persulfate) and subjected to electrophoresis under a constant voltage of 30 mA at 20° C. for 3 hours to separate the proteins.

(3) Detection of Protein Spot

Coomassie staining was performed by the method of Gorg et al. (*Electrophoresis,* 9: 531-546 (1988)) for the slub gel after the second dimensional electrophoresis. Specifically, the slub gel was stained under shaking at 25° C. for about 3 hours, the excessive coloration was removed with a decoloring solution, and the gel was thoroughly washed with distilled water.

Figure 2:
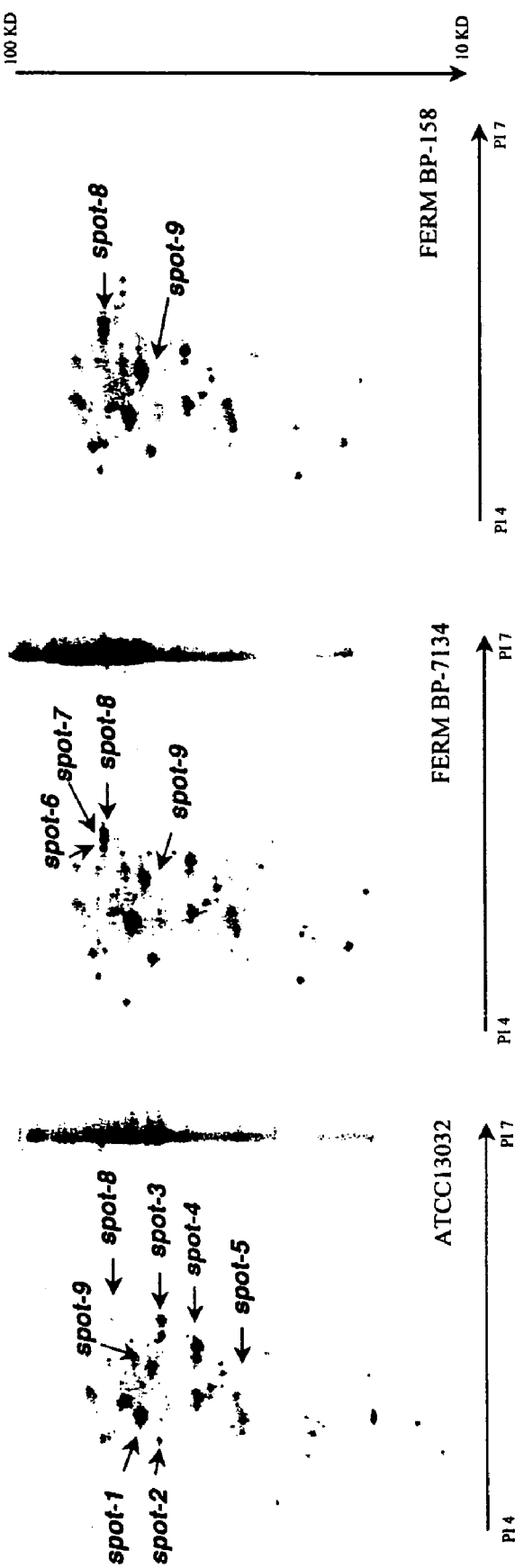
FIG. 2 is electrophoresis showing the results of proteome analyses using proteins derived from (A) *Corynebacterium glutamicum* ATCC 13032, (B) FERM BP-7134, and (C) FERM BP-158.
Figure 3:
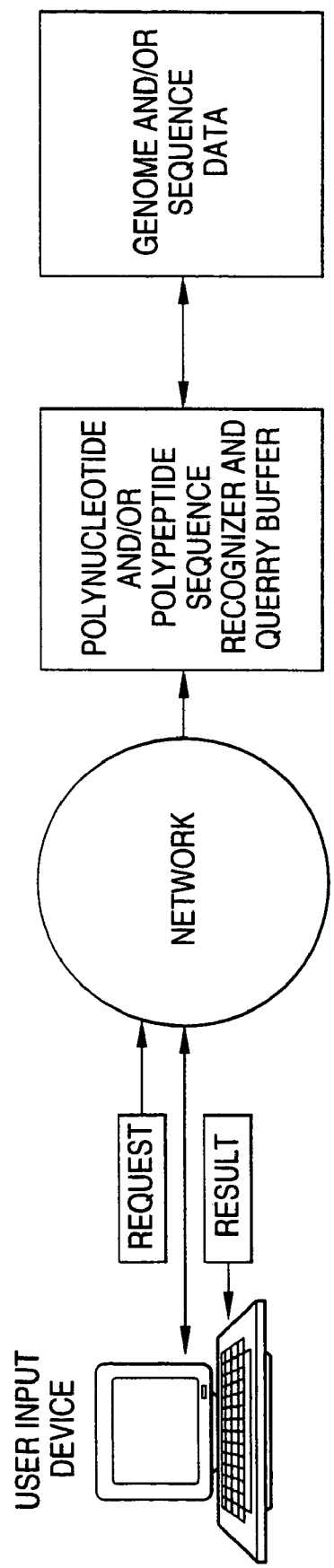
FIG. 3 is a flow chart of an example of a system using the computer readable media according to the present invention.
Figure 4:
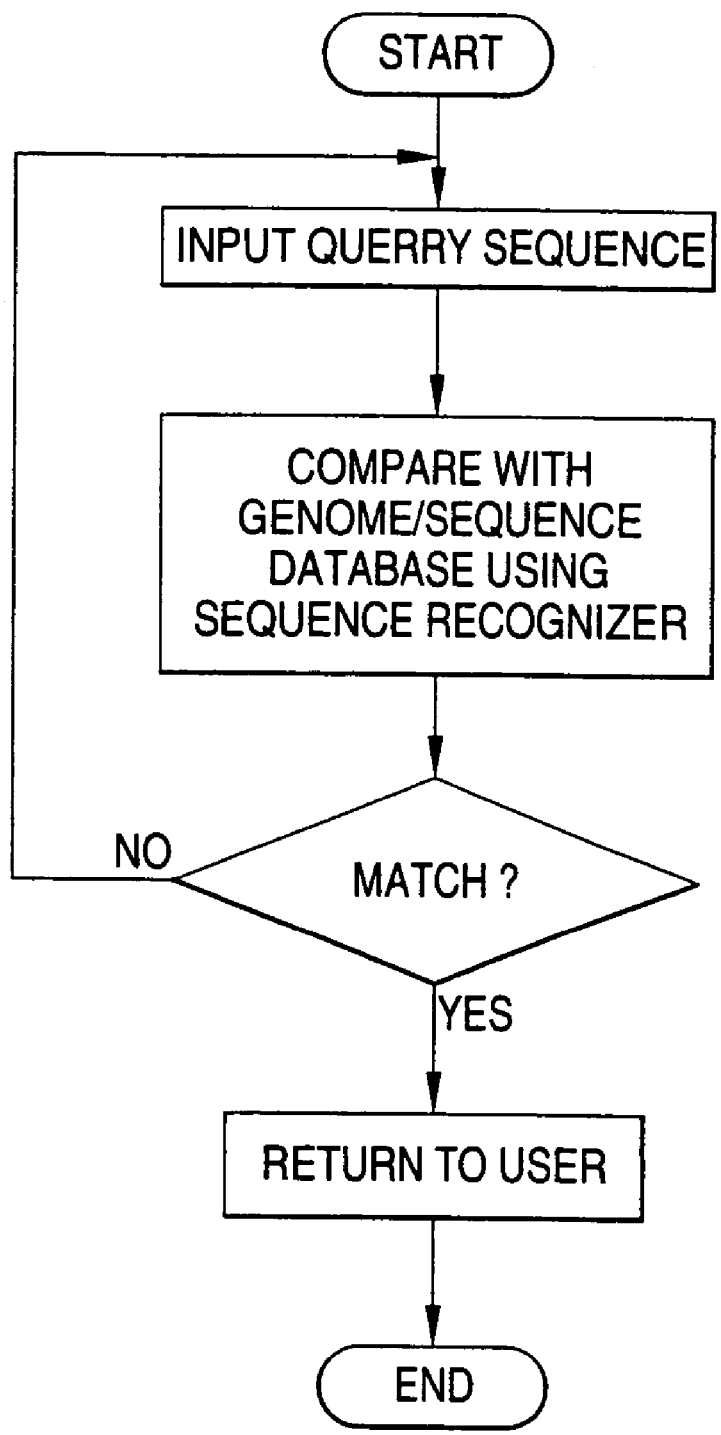
FIG. 4 is a flow chart of an example of a system using the computer readable media according to the present invention.

The results are shown in FIG. 2. The proteins derived from the ATCC 13032 strain (FIG. 2A), FERM BP-7134 strain (FIG. 2B) and FERM BP-158 strain (FIG. 2C) could be separated and detected as spots.

(4) In-Gel Digestion of Detected Protein Spot

The detected spots were each cut out from the gel and transferred into siliconized tube, and 400 μl of 100 mmol/l ammonium bicarbonate : acetonitrile solution (1:1, v/v) was added thereto, followed by shaking overnight and freeze-dried as such. To the dried gel, 10 μl of a lysylendopeptidase (LysC) solution (manufactured by WAKO, prepared with 0.1% SDS-containing 50 mmol/l ammonium bicarbonate to give a concentration of 100 ng/μl) was added and the gel was allowed to stand for swelling at 0° C. for 45 minutes, and then allowed to stand at 37° C. for 16 hours. After removing the LysC solution, 20 μl of an extracting solution (a mixture of 60% acetonitrile and 5% formic acid) was added, followed by ultrasonication at room temperature for 5 minutes to disrupt the gel. After the disruption, the extract was recovered by centrifugation (12,000 rpm, 5 minutes, room temperature). This operation was repeated twice to recover the whole extract. The recovered extract was concentrated by centrifugation in vacuo to halve the liquid volume. To the concentrate, 20 μl of 0.1% trifluoroacetic acid was added, followed by thoroughly stirring, and the mixture was subjected to desalting using ZipTip (manufactured by Millipore). The protein absorbed on the carriers of ZipTip was eluted with 5 μl of α-cyano-4-hydroxycinnamic acid for use as a sample solution for analysis.

(5) Mass Spectrometry and Amino Acid Sequence Analysis of Protein Spot with Matrix Assisted Laser Desorption Ionization Time of Flight Mass Spectrometer (MALDI-TOFMS)

The sample solution for analysis was mixed in the equivalent amount with a solution of a peptide mixture for mass calibration (300 nmol/l Angiotensin II, 300 nmol/l Neurotensin, 150 nmol/l ACTHclip 18-39, 2.3 μmol/l bovine insulin B chain), and 1 μl of the obtained solution was spotted on a stainless probe and crystallized by spontaneously drying.

As measurement instruments, REFLEX MALDI-TOF mass spectrometer (manufactured by Bruker) and an N2 laser (337 nm) were used in combination.

The analysis by PMF (peptide-mass finger printing) was carried out using integration spectra data obtained by measuring 30 times at an accelerated voltage of 19.0 kV and a detector voltage of 1.50 kV under reflector mode conditions. Mass calibration was carried out by the internal standard method.

The PSD (post-source decay) analysis was carried out using integration spectra obtained by successively altering the reflection voltage and the detector voltage at an accelerated voltage of 27.5 kV.

The masses and amino acid sequences of the peptide fragments derived from the protein spot after digestion were thus determined.

(6) Identification of Protein Spot

From the amino acid sequence information of the digested peptide fragments derived from the protein spot obtained in the above (5), ORFs corresponding to the protein were searched on the genome sequence database of *Corynebacterium glutamicum* ATCC 13032 as constructed in Example 1 to identify the protein.

The identification of the protein was carried out using MS-Fit program and MS-Tag program of intranet protein prospector.

(a) Search and Identification of Gene Encoding High-Expression Protein

In the proteins derived from *Corynebacterium glutamic* ATCC 13032 showing high expression amounts in CBB-staining shown in FIG. 2A, the proteins corresponding to Spots-1, 2, 3, 4 and 5 were identified by the above method.

As a result, it was found that Spot-1 corresponded to enolase which was a protein having the amino acid sequence of SEQ ID NO:4585; Spot-2 corresponded to phosphoglycelate kinase which was a protein having the amino acid sequence of SEQ ID NO:5254; Spot-3 corresponded to glyceraldehyde-3-phosphate dehydrogenase which was a protein having the amino acid sequence represented by SEQ ID NO:5255; Spot-4 corresponded to fructose bis-phosphate aldolase which was a protein having the amino acid sequence represented by SEQ ID NO:6543; and Spot-5 corresponded to triose phosphate isomerase which was a protein having the amino acid sequence represented by SEQ ID NO:5252.

These genes, represented by SEQ ID NOS:1085, 1754, 1775, 3043 and 1752 encoding the proteins corresponding to Spots-1, 2, 3, 4 and 5, respectively, encoding the known proteins are important in the central metabolic pathway for maintaining the life of the microorganism. Particularly, it is suggested that the genes of Spots-2, 3 and 5 form an operon and a high-expression promoter is encoded in the upstream thereof (*J. of Bacteriol.*, 174: 6067-6086 (1992)).

Also, the protein corresponding to Spot-9 in FIG. 2 was identified in the same manner as described above, and it was found that Spot-9 was an elongation factor Tu which was a protein having the amino acid sequence represented by SEQ ID NO:6937, and that the protein was encoded by DNA having the nucleotide sequence represented by SEQ ID NO:3437.

Based on these results, the proteins having high expression level were identified by proteome analysis using the genome sequence database of *Corynebacterium glutamicum* constructed in Example 1. Thus, the nucleotide sequences of the genes encoding the proteins and the nucleotide sequences upstream thereof could be searched simultaneously. Accordingly, it is shown that nucleotide sequences having a function as a high-expression promoter can be efficiently selected.

(b) Search and Identification of Modified Protein

Among the proteins derived from *Corynebacterium glutamicum* FERM BP-7134 shown in FIG. 2B, Spots-6, 7 and 8 were identified by the above method. As a result, these three spots all corresponded to catalase which was a protein having the amino acid sequence represented by SEQ ID NO:3785.

Accordingly, all of Spots-6, 7 and 8 detected as spots differing in isoelectric mobility were all products derived from a catalase gene having the nucleotide sequence represented by SEQ ID NO:285. Accordingly, it is shown that the catalase derived from *Corynebacterium glutamicum* FERM BP-7134 was modified after the translation.

Based on these results, it is confirmed that various modified proteins can be efficiently searched by proteome analysis using the genome sequence database of *Corynebacterium glutamicum* constructed in Example 1.

(c) Search and Identification of Expressed Protein Effective in Lysine Production It was found out that in FIG. 2A (ATCC 13032: wild type strain), FIG. 2B (FERM BP-7134: lysine-producing strain) and FIG. 2C (FERM BP-158: lysine-highly producing strain), the catalase corresponding to Spot-8 and the elongation factor Tu corresponding to Spot-9 as identified above showed the higher expression level with an increase in the lysine productivity.

Based on these results, it was found that hopeful mutated proteins can be efficiently searched and identified in breeding aiming at strengthening the productivity of a target product by the proteome analysis using the genome sequence database of *Corynebacterium glutamicum* constructed in Example 1.

Moreover, useful mutation points of useful mutants can be easily specified by searching the nucleotide sequences (nucleotide sequences of promoter, ORF, or the like) relating to the identified proteins, using the above database and using primers designed on the basis of the sequences. As a result of the fact that the mutation points are specified, industrially useful mutants which have the useful mutations or other useful mutations derived therefrom can be easily bred.

While the invention has been described in detail and with reference to specific embodiments thereof, it will be apparent to one of skill in the art that various changes and modifications can be made therein without departing from the spirit and scope thereof. All references cited herein are incorporated in their entirety.

SEQUENCE LISTING (7059 sequences)

SEQ ID NO: 1 - DNA, 3309400 bp, Corynebacterium glutamicum (residues 1-1,654,700 of 3,309,400)
gtgagccagaactcatcttctttgctcgaaacctggcgccaagttgttgccgatctcacaactttgagccagcaagcggacagtggattcgacccattgacgccaactcaacgtgcatatttgaacctgacgaagccgattgccatcgtcgatggctacgccgtgctgtccacacccaacgcgatggcaaaaaatgtcattgaaaacgatttgggcgatgctttgacccgtgtgttgtcgctgcgcatgggccgatcattcagcttggctgtcagtgtggagcctgagcaggaaattccagaaaccccagctcagcaggagtttaaatatcagcctgacgcacctgtgatctcttccaacaaggcgccaaagcagtatgaagttggtggtcggggagaggcgtcgacaagcgacggctgggaacgtacccactctgcaccggctcccgagccgcacccggcacctatcgccgatcctgagccagagctggccaccccgcagcgcattccgcgcgaaaccccagctcacaaccctaatcgggaagtgtccctcaacccgaaatacacttttgaaagcttcgtgatcgggccgttcaaccgtttcgccaatgcagccgcagttgctgtggcggaaagcccagcgaaagctttcaacccgctgtttatttccggcggttccggcttgggcaaaactcacctgctgcacgcagtaggaaattatgctcaagaattgcagcctggcctgcggattaagtacgtctcaagtgaggaattcaccaacgactacatcaactccgtgcgagatgaccgccaggaaaccttcaagcgccgctaccgcaacctggatatcctcatggtcgatgacatccagttcctggctggcaaagaaggcacccaggaagagttcttccataccttcaacgcattgcaccaggcagataagcaaattattttatcctcggaccgcccacccaagcagctgaccacgctggaagatcgcctgcgcacccgcttcgaaggtggcctgattactgatattcagccacctgacctggaaactcgcatcgcgattttgatgaagaaggcccaaaccgatggcacgcacgtggatagggaagtcctcgagctcattgccagccgctttgaatcttcgatccgtgaattggaaggcgcactgattcgtgtgtctgcctattcttcgttgattaatcagccgatcgataaagaaatggccatcgtggcgctgcgcgatatcctcccagaacctgaggatatggaaatcaccgcaccggtgatcatggaggtcactgcggaatattttgaaatttccgtggatacactccgtggagcaggcaaaactcgtgcggtcgcgcatgcacgccaactggcgatgtacctgtgccgcgagctcaccgatatgtcattgcccaagatcggtgatgtgttcggcggaaaagaccacacaactgtcatgtacgcggatcggaagattcgccaagaaatgacagaaaagcgcgatacctacgatgaaatccagcaacttacccagctgattaagtcgcgcggacgtaactaagacctgtttagcgtggcgctaaattacaaaatttagctctgctgctcttgaagacccatcttcggatgggtctttttgtaatttaggggttgtgcagggattttgtggataacttccgataaaagcccagctcacaaagttatccacaaccttattcacagcagtgtaattacaaacttgtaattcagtgagctttgtcacaggaaatgtgattccgcggaactttccgccctgtgcacaactccccaaaaattggggataagctggggatacatctgcacagactggggataaaatccgtaccttgaaatctatccacagatagacaaagttatccacaatcaattcacaacccagttcacacgccagaattccgcgactaccttgtaaaacaatggtctatccacagtttcaacaggacttactgttattaccaattttttacctagaaattaactaaaagaaagagggggtggggagaaagcttcgtgggtgagctcaatgctcacgaaacttcagcgaaagcctcgaggaaattgaaattacaaattccagatccgcgaggaacacaggtaggttgggtttgtgtaattcggactgaagccacctggagggtgaaccttcttccaagaagttttccctatcggtaaacgtccgggtttagttaaacgatgaactatatttgatctatatttcccaaggagctttaaaacagcatggagtcacaaaacgtgtccttccgtgtggccagggaagacctggttaccgcggtagcctgggtcgctcgcaacctgcccaccaaaccgactcagccggtacttcgagccatgctgatcactgccgatgatgagggtcttgaactcgccggttacgactacgacgtatccacccgagttcgcctctcagctgaggtttctcagccaggtcgcatcgcagtagccggcaagctgctgtctgaaatcacaggatctttgcccaacaagcccgttgatttccgcatcgacggatccaaagcttttgtcacttgtggttcttcccgcttcgagctgccactgatcccgcttgatgattacccaatgctgcccaagcttcctgcaggtaccggttccatcaacgccaagctgttcaccgaagcagtctcccaggtggcatccgctgcaggtaaagatgattctttgccgatgctcaccggtgtcagcatggaaatcgtgggcaaccagatcaacttggctgctactgaccgtttccgcctggcgctgcgcaccttcgaatgggaagcaaacgacccagagctcaacgttaaactgctgattcctgcccgcaccctgctggacaacgcgcgttctttggattccggtctcaacgattccatcgacatcgctgtcggtaccggcgatcaggttggccgcgaaggactattcggcgttcacaccgataaccgcgaaaccaccaccaggcttctcgacgccgatttccccaacatcgcaccactgcttcccaaagagcacaccgcgatcgcatcagttgaaatcgcaccgctggtcgacgccatccgccgcgtatccctggtggcagaacgcaacgctcagatcgtcttgcacttcagcgaaggccaggtcatcttgactgcaggcgcaaccgaggcaggccacgcggaagaaaccctgccgtgtgcattcaccggcaaggaactgaccatcgcgttcaaccctggctacctgaaggatggactttctgtagttccaacttctcgagcagtcttcggattcactgagccttcccgcccagcgatcatgatcccagagcctgaagaaatgccttccgccaacgaaaatggcattttccaaactccggacacctatttcacctacctgctcatgccagtgcgcctgccaggctaaacacaaaagtttcacccttttcgcgcctgactttgtacacttttcaaccgacaaagtcaggcgcgttatccaatccacttcccaccgactaaaaggaggtcagacccgatgcacatccgttctttggaattacgtgattaccgttcctggcctgaactcaaagtggatttggaacctggaattacagtttttatcggccgcaacggttttggtaaaaccaacatcgtcgaggccatcggctatcttgcgcatttgtcatcgcatcgggtgtcctctgatgcgccattggtgcgggcgcacgctgaaaacgcccgagtttcggcggttgctgttaatcaaggccgagaattggcagctcacttgctgatcaaaccccatgctgcgaatcaggcaagtttgaatcgcacaaaagtcaggactccccgggagctgcttggtgtggtgaaaacggtgctgtttgcgccggaagatttggcattagtcaaaggcgagccagcagaacgtcgccgctatttagatgacattattgccactcgccagcctcggatggcgggggtcaaggccgactacgacaaggtgctgaaacaaaggaacgccctgctcaagaccgccaccattgcgcttcgtcgaggttacggcaccgaggaaggcgcagctgcgctgagtactttggatacctgggatggccagttggcacgcctgggtgctgaagtgatggcagccagatttgccctgctcaatgagttggggccgaaaatctatgaggcttacaccacgatcgccccggaatcccggccagctgcggtgaattacaaaaccaccatcgatcaaggcctgtcgcagttttccgaattcgatgccggcatcatcgaagccacgctgctgacagaattggcagcgaaacgtcaacgagaaatcgaacgcggctcaagcctggtcggcccccaccgcgatgatgtcgatttaatgctcggcgatcagcccgccaaaggctttgccagccacggcgagacctggtctttcgcgctttcactgcgaattgcagaatttaacctgctgaaatccgatggcaccgacccgatcctcatcttggatgatgtgttttccgagctcgacgccggccgtcgcgaaaaactcgtgggcatagcgcaagaggtggaacaggtgctcatcaccgctgcagtccacgacgatctgccggagaatctcaagaaagtgctcactgcgcagcacaccgtcaccgtccaagacaccggcaccgggcggatttcactcctggatgtgcaaccatgacagatccaattgagcaggcatttgaacgcatccgcgccgaagccatgcgcagaaatggatccgttcccgacctcaataaaaacgatgcttttcgacgcccacctgcgccgaaagggggcgtcgaaaagcgcaaaaaaggccgtgcaagcggcctagacggccgccagaaacgatatgtgcgcggcgcggagtcgctgggatcggtgctgaacaaggaaattcagcgtcgtggctggggcaaagacattgccggcggttgggtgacgtccaactgggaagagcttgttggcgcgaagattgcgcagcatacgcgcgtggaaatgatcaaagataagaagctttttatcacttgtgattccacagcgtgggccaccaatctgcgcatgatgcagcggcaaatcctgcaggtaatcgctgaaaaagtgggtccaaatattattacagagctgcgtatttttgggcctcaggccccaagctggcgcaaggggccgttgcacgtaaaaggacgcggtccgagagacacatacggatagtttggtgataaaaaccgtcgaattggggcctattttgccgtttctcgcgttgtgcgtggtactacgtggggacctaagcgtgtaagatggaaacgtctgtatcggataagtagcgaggagtgttcgttaaaagtggcaaacactgaacacaattatgacgcttcatcgatcaccatccttgaaggtcttgaggcggtacgtaagcgcccgggcatgtacatcggttcaactggaccgcgtggactgcaccacctgatttgggaagtcgttgacaactcagtggatgaggccatggctggccacgccaccaaggttgaagtgacccttctggaagatggtggcgttcaagttgtcgatgacggtcgaggaattcccgtcgatatgcacccatccggtgcaccaaccgtgcaggttgttatgacccagctgcacgccggcggtaagtttgactccgattcttacgccgtttccggtggtctgcatggtgttggtatttctgtggtgaacgccctgtccacccgcgtggaagccgacatcaagttgcacggcaagcactggtaccaaaactttgaaaagtctgttccagacgagttgatcgaaggcggcaacgctcgcggcaccggtaccaccattcgtttttggccagacgctgaaattttcgaaaccaccgagtttgatttcgaaacgatttctcgacgtctgcaggaaatggcattccttaacaagggtctgaccatcaccttgacggacaaccgcgccaccgacgaggaactcgagctcgaagcactcgctgagcagggcgaaaccgcaacggaactatccctcgatgagatcgacaacgaaaccgaactcgttgaagagaccaccgatgctccaaagaagccaaaaaagcgtgagaagaagaaaatcttccactaccccaatggcctcgaggactacgttcactacctcaaccgcagcaagaccaacatccacccttcaatcgtgtcattcgaggcaaagggagatgaccacgaggttgaggtggcaatgcagtggaactcctcctacaaggaatccgtccacaccttcgccaacaccattaacacccgcgaaggcggcacccacgaggaaggtttccgctctgcgctgacctccctgatgaaccgctacgcacgtgagcacaagcttctgaaagaaaaggaagcaaaccttaccggtgacgactgtcgtgaaggcctgtccgcggttatttccgtgcgcgttggtgacccacagttcgaaggccagaccaaaaccaagctgggcaacacggagatcaaatccttcgtgcagcgcatggccaacgagcacatcggccactggttggaagcaaaccctgctgaagccaaggtcatcatcaacaaggctgtcggttccgcgcaggcacgccttgctgctcgaaaagcccgtgacctggtccgacggaagtcagcaaccgatctgggtggactgcccggtaagcttgccgactgccgttccaaggatccagaaaagtccgaactttacatcgtggagggcgactccgcaggtggttctgcgaagtccggccgtgactccatgttccaggcaatccttccactgcgaggcaagatcctcaacgtggaaaaggcccgcctagacaaggttctgaagaacgccgaagtccaagcgatcatcaccgcactgggtaccggcatccacgacgagttcgacatcaacaagctgcgctaccacaagatcgtgctgatggccgacgccgatgttgacggccagcacatcgcaacgctgctgctcaccctgcttttccgcttcatgccagacctcgtcgccgaaggccacgtctacttggcacagccacctttgtacaaactgaagtggcagcgcggagagccaggattcgcatactccgatgaggagcgcgatgagcagctcaacgaaggccttgccgctggacgcaagatcaacaaggacgacggcatccagcgctacaagggtctcggcgagatgaacgccagcgagctgtgggaaaccaccatggacccaactgttcgtattctgcgccgcgtggacatcaccgatgctcagcgtgctgatgaactgttctccatcttgatgggtgacgacgttgtggctcgccgcagcttcatcacccgaaatgccaaggatgttcgtttcctcgatatctaaagcgccttacttaacccgcccctggaattctgggggcgggttttgtgatttttagggtcagcactttataaatgcaggcttctatggcttcaagttggccaatacgtggggttgattttttaaaaccagactggcgtgcccaagagctgaactttcgctagtcatgggcattcctggccggtttcttggccttcaaaccggacaggaatgcccaagttaacggaaaaaccgaaagaggggcacgccagtctggttctcccaaactcaggacaaatcctgcctcggcgcctgcgaaaagtgccctctcctaaatcgtttctaagggctcgtcagaccccagttgatacaaacatacattctgaaaattcagtcgcttaaatgggcgcagcgggaaatgctgaaaactacattaatcaccgataccctagggcacgtgacctctactgaacccaccaccacagcccatgttccactacctgatggatcttccactccagtccaaatttgggcgtcagataacaaagactcccaactggtgatgctgtggccaggtttcggcatgggtggctattactatcgtccgcttgcggcagcgctaaataaagctggattccatgtggcgattggtgaacttcgtggtcaggggcaaagttccgcgaaggcttctcggaaaagtcagtggggataccatgatctcgcatcggtagattttccgctgcagattgccgctgcgaaaaaggcgcttgacctggaggaaggccatcccatgaggtttttgtcgcattcgatgggtgggcagatttcttgtcttttcgcagcgaggccggaggctgagaaatataatcttcgggcgattttcggggtgggtgcagggtcgccgtttaggcctacgtttagtccgaaaatggggaagcgtttgggattgggtgcggtgctgcttggtgggattggtggccacattgtgggattttggcccggcaaagttttaggaaaagacctggtgggttatggccgacaatcgggaactcacatgagggaatggcgtcgattccataagcacaattctttggacgatctcaccgcgcaggacatcaactatgtggaggtgatgaagaaggtgagcattcctattacttttagtcgttgtcctgatgatgaggactgcccgcaggcatcgattgatgggttggcgagttttgttcccgcagcgcagatcaaaatgatagaaattccagaagccctgggacataaccggtgggctcgggaacctgaatcaacagtgaaactcttcctggaacaagctctttagtgaccgatggagcggaggtagagtttgcgccactggcggacgaagaatccgatgaaaaacgccgcgaacactgttccttcgcgcacgccaataagtccacccatggtgatccaggacaaaatggcagcgacggagacgaaagtccagtcgacgatttgtttcatggtgccaaattccacgttgggaaatttcttcaccagcgcagagacaatgccttcaccagcgatgaaagtgatgttggggagtacttgaataaaaactccgatcgacatcaaaatggtggacacaataacccagatccaggccacaaaataattgtcagtttgcgcccaggtggttagttgcaggcttaaatcacaaagaaacccaaagaggaatgcccacaggatttggactaacatttgtggtttgaactgggaacgcagcacaattatttggcacagaatcatgaagccattgaagtaaattgtggtccagcccagggataatccgctggcagcagtccacaccacgggaagtgatgaaattgtggtggttcctagtcctgcgtggacggtgatgccgatggcgaaggacataataaagatcccgacaaagaacatcgcccatctggtggggagggagaatctttgtgcgggatctaaaggtttcttattagggttgctcacctaattattgtgcgttcttttcgatcaactggccaattgcaggaagttcctgctcgattactttggcagccttgccgcgcacgcccttgtagaccttgccaagtcctggaacgttgatgctctctgcgtttttgtcagcaacgctgagaatcgcgtcgagtgcggtggagctgttggcctcgaggtgggcgccgaaatctgcggcggtgccaccattttggtattcctgccagagtccgtcgagggagtcagcgatttccgggaggaggcgcctggagcctttggctacgatgtcggagtcgatcttggttgcagcacccattgcgcctttgagtgcgatgccgctgatgccggattgcttgcccacggtttcttcgataaatgctgacatatctgcaattgctgcgtcggcattggtggaaacaagtaagtccctgagtgaagtcatgttctacatcttaagtgaaatgagaaaagaccggcgttcgacgcttcgtttaagcggacgcacggtcattctcttgaaaaagcgttgcaacccttcctccacagaaactgaaaaccacatcagtcactgcaatcacaacagtcacaaagcttacatttagtaatatcggccccgcaacatgggtggtaattacacaaatgccaacggatcttgacggatcggatgcagcgccacctggatggccgcggtgcggagaatgtaggcgtctgcgcgttggattctcagttggctgccggtgtttgctcggagctgggtcaccacaatgcgaagagtttccggatccagggtgaaggcttcgccggcgaagacgacggcttcggggtcgacaacatcaacggcggtggttacggcgtcggcaagtttgtgggcgcgctcgttgaggatctgtcgtgcaagcgggttggtgtgggagagttggactaaatcggagaaagttgttggtgtgagtccacgtcgaaaagcatcttttaaggtatttgtatttccgaacgccgtcggcgtgcggccgctgttggggcggtggacagcgccgttgaaaatccaggcgtgggagaccatttcgcgggcgtagaaatacagcgtggactgcgtggattgggtcagtggcgcgttgataatttccgaaccggccatcgccgcaacacctgatccgatggtggcggggaaggggaggtgtgccccaatttccacctctgaccagccataatcttcggaagtgacggttccgttggcgcttaagtgggcagataatgccacgcccacattgcggggctcgggcaagccggcgctcaatgtttgtaacctatgtgcgacaaaattcagcgtttccgacggcgtggagtgtgaaacttcatggtccacgcgctcatacctaatcactcggccggctaaatcgcacaccgcaaaatccgtgctgcgcaggccaatgtgcactccccaggcggtgagatggcggccgtcgatgcctaattttgtgcgcggtcgccccgagcgcgccccggaatccactcgggtttcctccacgagacctgcatcaataagcgctgacacatgccgcgtgatgccagcttgggagagttcaagatcgcgttgcagagaggtgcgatcggcgtctgtggcgcgaatttgatgaaatacgcgcgcgacgggtaggtggggggcggtgatgtgaatggggagtgttcgctgtgcaagcatgaacacatgttagaccgtatggtctatttgggaatagtttagattcaagaatttagctgcgaaaacgtgaacaaatagaccgttcagtctatttgttgatctctaaaagtactctctgggtgactgccgcgaaggtctcgtttcgaccactcaatggctttaatgctctgatcatttcagaaacttttcctgccatcgcctcagctgatccaaaaacgcgcacgccgtggaagttggccgtgcttactgctgcggcggctgcaagcgctgcgaaatcccgcaccacaacgccgtgttccgcgcacacctcatcggcgatggccagcacattttccgcgcttaagcccttcatcgggcttgcctaattcgcttttcgacgcccgcatactcgtgcagcatcgtccgggcgagcccggcgatctcagcgtcgtcgaccgccctgcttgctgccgcaatgattgctcgcgtggcagcttcctgtttgctgcagccttgggtcctggcaagcagggtgagggcgcggtcctgggcgtcgttaagccttaaagtcattgccatgcccaaaatggtatcgctttgataccaattttggggcatgcaaggcgttaaaacggcctgtggactaaaatcggtagggttgacacgaagaaaggtgatcagtgagcgacgacaataccggacaatttgaccgcgttaatcccattgatatcaatgaggaaatgcagtcgagctacatcgactacgcgatgtcagtcatcgtcggacgtgccctcccagaggtgcgcgacggcctgaagccagtccaccgccgcgtcttgtacgcgatgttcgacaacggctaccgccccgaccgcagctacgtgaagtctgcaaaaccagtggcagacaccatgggtaacttccacccacacggcgacaccgcaatttatgacacgttggtgcgcatggctcagccatggtccatgcgatacccgctggtagacggccagggtaacttcggttcccgcggcaacgacggccctgcagcaatgcgttacaccgagtgccgcatgaccccactggccatggagatggtgcgcgacatccgcgaaaacaccgtcaacttctcaccaaactacgacggtaaaaccctcgaaccagacgttttgccatcgcgcgttccaaacttgttgatgaacggttcgggcggcattgcggtcggcatggccaccaacatcccaccgcacaacctcaacgagcttgccgacgccatcttctggctcctggaaaacccagacgccgaagaatccgaagctctcgaagcctgcatgaagtttgtgaagggcccagacttcccaaccgctggcctcatcatcggtgacaagggcatccacgatgcctacaccaccggccgcggctccatccgcatgcgcggtgtcacctccatcgaggaggaaggcaaccgcaccgtcatcgttatcaccgagctgccataccaggtcaacccggataacctgatctctaatatcgcggagcaggtgcgcgacggcaagctcgtgggcatctccaagattgaagatgaatcctccgaccgcgtcggcatgcgcattgtggtcaccctcaagcgcgacgcagttgcccgcgtggtgctgaacaacctgttcaagcactcccagctgcaagccaactttggtgcgaacatgctctccatcgtcgatggcgtgccacgcacccttcgcctggaccagatgctgcgctactacgtggcacaccagatcgaagtcatcgtgcgccgcacccaataccgcctcgacaaggctgaagagcgcgcccacctcctccgcggcctggtcaaggccctggacatgctggacgaggtcatcgcgctcatccgccgcagcccaaccccagatgaagcccgcaccggcctcatgtcgcttctcgacgtcgacgaggcgcaggctgacgcaattctggcaatgcagctgcgtcgcctggcggcactggaacgccaaaagatcatcgatgagctcgctgaaatcgagctggaaatcgctgacctgaaggccatcctggcaagcccagaacgtcagcgcaccatcgttcgcgatgagctgaccgaaatcgtggaaaagtacggcgacgagcgtcgttcccagatcatcgctgccaccggcgacgtgtctgaagaagacctcattgcgcgtgaaaacgttgtcatcaccattacctccaccggttacgcaaagcgcaccaaggtcgatgcctacaagtcgcaaaagcgtggcggcaagggtgttcgtggcgcagagctcaagcaagatgacattgttcgtcacttcttcgtcagctccacccacgactggattttgttcttcaccaactacggtcgcgtgtaccgcctcaaggcattcgaacttccagaggcatcccgcaccgcacgtggacagcacgtggccaaccttctggaattccaacctggtgagcaaatcgcccaggtcatccagttggaaagctacaacgacttcccatacctggtgctcgcaaccgcacacggtcgcgtgaagaagtcccgcctgctcgactacgaatcagcacgttccggtggcctcatcgccatcaacctgaacgaggacgatcgcctcatcggcgccgcactttgcggtgaagaagacgatctgctgctggtctctgaattcggacagtccatccgcttcaccgccgacgatgagcagctccgccccatgggccgcgccaccgccggtgtcaagggcatgcgcttccgcgacaacgaccaactgctgtccatgtccgtggtccgcgacggcgaattcctcctcgttgccacctccggcggctacggcaagcgcaccccacttgaggattactccacccagggccgtggtggcctcggcgtggtgaccttcaagtacaccccgaagcgcggtcgcctcgtcagcgccatcgcagttgaggaagatgacgagatcttcgccatcacctccgccggcggcgttgttcgcaccgaagtcaagcagatccgaccatcctcccgtgcaacaatgggtgttcgactggtcaacttggaagaaggtgtagaactgcttgccatcgacaagaacgtcgaagaccagggcgaagcatccgcagaagcagtagcaaagggtgcagtcgaaggaccagcatccaagactgctgccgaagaaaccgactccgttgacaacggatccgacgaaaacggcgaggaataatttatggcatcccgagaagtatccatcacccgaatctcaccactagcaaccttccgagttgcactggcaatgtccatcatcggactcgtggcgtggatcatctgcgtaaccgtcctctatttcggacttaacgtggctggcgtctggcagaacttcaacgatgtcatcggcggtgttggtgcagaacaaaccatcaccttcgggctcgtcctgagcatttccgcacttctgggagctatcggagcgattaccgtcgctgtgcttgcaccattgtgtgcaatcatctacaactcgattgttgacctcttcggtggactgcagattcaactgcaagaagaagtagactaacctctgaaacacaaacccctagacactgctaaatatagcctttgaacaggggatttgttgtattgttaacttgaaggtagagtcttatctcgttcctagaggggcctatagctcagtcggttagagcgcatcgctgataacgatgaggtcgcaagttcgattcttgctaggcccaccaggaacaaaaaaggggcattagctcagttggtagagcacctgctttgcaagcaggatgtcaggagttcgattctcctatgctccacagttttcccggttcatcttgtttaaggtgggccgggatttttgttttttagtgtttctgggatacctcggtggcactccggcggcactctgggtcattggaaagctgtgtgtactttcgacaacaagatttgggcaaaatggtggtcaaaatcaggaaatcttgttgtcgaaagtacaactgggtcttcggttctatccgaggtgggtgagtagggtgcctgcaagtgcgatactggtgacaagtgtcgtggatccgaaagccagaatgaaaggcttgaccccaacatggatcaggttctggatttttacgccacacccgagaccaaacattgctgcagagagcaaggctgtctgtaggaaacctccagccgcaattacctcgtctgggagcgcaacagtggagcgcaaaactaccatcgccaagaatccaaggataaataggggaacgaccggtggtctctttccatcgggggacgtgtaaccctggcggcgctggcgaaaacttaaaatggcagcaatgggtgcaagtaggagtactcgggcgagtttcaccacaactgcaacacctaatgctccaccaccaatgactcctccagctgctactacttgggcgatttcatggatggatccgcctgcccacatcccaccgatttcaggggataaccccaagactttggttgcgaatgggataaaaggaatcatcagcgttccgaaaataacaacaagtgcaaccgcagtaacgacctcttcttcttcggaatcagttactccttcaacacctgccacggccgcagcgccacaaatagaaaagccacaagcaatcaacagaacttgggttggtttcattctgagcaggtgtcccatgaggatggtcccaaaaataccaccggcaacgatgcacacaatcaccgccagcatggggaaaccaagtgacaaaatatctgagaaaactaactgcagaccaaggaagacgattcccagccgcaaaagctttttcgacgccaacgtgatgccgggtgaggtcgatgctgggagctgaatcaggttggtcaggatgatgccaagaatgatcgcgacgataagcggactcacaccagagaaaaagtgattcacgatcatagcgatgagtaccgcaatggagcataagagcaggcccggggtgtacttctggaggactccggtgcgaagttgggtaaagggcggcgtcgattccagaaggtttgtagacatgcttcaaggttgcgctaattgaaaagaacgcggtagacggtactttcatatccacccatataatgttgatatggataatgggtggccgaacctgcaaactctcgcactctttgtggcgattgtggaagaggggagcctcggtgccggtgctcgaaaagtcggaatggcccaacctaatgccagtcgggctatcgcagagcttgaggcagacatgaaagccgaattgttggtacgtcatcctcgaggatcacatccaacagctgctggacttgcgcttgttgagcattcgcgcgatctgcttcaatctgtacaagaatttactgaatgggtgacagagggacgaactgagcagccgctgaaattgcatgttggggccagtatgaccattgccgaggctctacttccagcttgggttgcggacatgcgcacgcgttttcctgcctgccgtgtcgacgtctctgtgatgaattcttctcaagtaattgaagccgtccagaaagggcacttgcaactaggttttattgaaacaccgcatgttcccgtacggcttcatgctcgtgtggtgcaagaggacaagctgattgtggtgatttctcctaatcatgagtgggctaatcgcacgggtaggatcagtcttcgggagttgtcggaaactccgctgatagtgagggaagtcggctcaggtacccgagaagcattacaagaattacttgcggattatgacatggctgagccgattcaagtgttaaacagcaatgctgcggtacgtgttgttgttgaagcaggggcaggtcctgcagtacttggtgaattagccttgcgtgatcatcttgcgctcggcaggctgttgagtgtgccatttgaaggcagtggagttactcgtcctcttacagctgtgtggagtggaccccgcagattgccgattctagcgggagaattagtgtccatcgcatcgaaccacatctgattttgagccctggctaacggattgtttttgacagattggaatgacaataatgaacgagattccagaatggttgactcttgtatctgttgaagcaggaaagagacttgggctgcctgggccattggtgtttccgccggagttggtcactttggcagttgaagggattgagcttattgaacttgagccttcatggacttctgattttcctctgccggaattcgggttcctagctgcggatatggttgatttctatgatgattatgagtttagtgaatggattccgggtgcgtggcctcttgctttagatggtggaggaggtttcttttgccttgatctccgtgctgccaacgctgatggagagattcctgttgtgtgggtgcatgccagcaacttgggttggggtgatgatgaggcagtacgcgtagctgcctcgttggcagatttgttgagtccgtcgaaatagaagaattagcatttaccggaattgacggtaaatagtgatgccgtggaattatggagaagttgggcggatggaagtttttgatcattttgctgaagtcgtcaaagctatggggcgctcgttatttttccagcgctgcccctgacgcgaactaattccaatactgcctcgctccaaaactaataattagcgagggttaataacccatccactttctttgggtcgctgagcttcttcttttcgcttttgtcgtttgttccagaagtacaagaacaagccagcggcgacaatgatcaatgcgatgtcaaagagtggtgacccgagtgagaatgtggcttcctgtagccagatctgggtgtccattggaacgagctccggcatgctgacaaggccgttcgtggaccaaaagaggattccgacagcgatgatcagggcaccgctaatgacagaaacaatgtgccactgcctgcccaagaaggtgaattcccggccgcggagcatctgctgtccacgctgtccgagtttggcccagagcgctgcaatagccatcaggggcagcaccattcccgcaccataagcactcaaaatgagtgctgaggtgatggagtttccactggtggcagccaaagtaagaacggcgccgaggattggtccggaacaaaaaccggcaatactactggtcattcctagtaaaaagctctttcctagacctgaggtcacagtggccttagattgcagacgatctaatcctgggagtgcttttccgaagtcgaatccgccgccgaagatctggacaaaacctaggataatcagcacgatcgatgaaaccacgatgatggtctggcgttgggtgataaacagctcgccgaggattcccgcaccaaggccaagtggcacgagaagtactagaagtcctgcgtagaacacaacaccgtgaaggatcatgcgcgggccagcacccactgaggatgcaaaaaatgctggtaaaaggagtgcggcacaagggctaagtagcgcgagtgtgccaccgagaaaagctgtaactaggccgacatccacggtttattctttcgctgccagtgcttgctcgaaggcggcttcaaatacagaagcaggctgagcgcccatgattggctggccacctaggaggaaagctggggtggagtaggcgccaagatcgattcccagctgttgatgttgcgcaattgcgactgcagtttcaggggattggaaatcggcagtgaatttcgattcgtctagtccaaggtcaccagcaagcttaataagtccctcttcgctgagcaggtcttcgctgggtttttcaccgttggcaaagagtgcgttgtggtattccaagtatgcgtcctgcaaacccgcagcgtatgccgcgcgagctccacgctcagatggttctccaaagatgttcacttcacgccattcaatgcggaggtttccatcttccacatgcttcatcatctgtggcagggtttcatcgctccactttgcacagaacgggcattggtagtcggaaaacaccactaacccaacaggtgcatcaacgtctcccaccgcaacagggtcggaagggtcgcgtgcttccacgctggtcagatcggagtccgcagcaccagaagcggaacccgaagcagcagtcgaagcagcagccgagtccgaagtcgcagcggctgaaacgccctcggccgtatcactcgcatttcctcggtacatcaacagaacaactgcgatgaggagcactgcaatgatgacgaccagtgtcggtacgagccactttttactctgttggttcactgaattctccttaaccatccctgctgggaagccctcaactaaaagccctcaactaaagtcgcctagctaaaagccatgaataaaactcaactatggcgactatgccacatagtcgactaccttgcatagttgactatttgattgagttgaactgtgtcagtgtatgaagagaaaaatgaagagaaaaacagctgcacatggtttcaaaagataaggaagtgaagcatgagcatcgagccaggaatccccacgcttggaccgcttgaagaacaagtcatgcacattctgtgggatcacggaaaattgacagtccgtgaagtcatcgaattccttccaggtgatcctgcgtacacaacgatcgcaaccgtcctgcgtcacttgggcagaaaaggcatggtcaccaccgtcaaagatggtcggactgcccggcacagcgcgttgatgaacagggagcaatacaccgccggcatcatggaccaggtgctgtcgaccagtcgggatcgcagtgcatcgattctgcattttgtggatacaatcacggcaactgatcgcgagctgcttctggagtacctgcaacagcaggagggtaggaaatgactgcggcttcggcgttaactgtagcgctcataattgggatttcactggctgtcattggaatttttggtcctgcgcttcttcgccacgcagcgccagcgctggctaaaactccgcacctagcagtggcgttgctcatcggcggtatcctcgtttggccaaccacgctgcttgccttgagtcttgcgttggcgtgggtgttggtaggtccagcgcttcttccacaaaaagctgctttagtttgtgaacagtgcttgaccgcggctaatccgttttcggtggagtccattcagacgacgctgcccaccgtgctgctcctggttattccgacggtgattgcggcgatgtgcaccgtcggcatcgcggcgcagtttatggcccgggtgcggtgctcccgttccacggcggcgcgtgtgcagcatgaagcttatcgacgcccccttctcggctacaacgtttccgttgtccacgatcaccgtccttgggctctgacgttttcacctcgtcttggaggaataaccctctcttcaggggcgattgatcagttggctgatgatgaactcgaggcagtccttgcccatgaacaggcccacatggatcaacgacaccacattgtcaccgcattggtggacagtatcgcagcacaactgcgatgggtaccgtttattcgagaagccgcagaagtcctgccggactatttagaaatcgctgctgatcaacaagcctgcagaaaagtaaacaccacggcgttggttcgggctcttttagttttgggggagaagaagataccgacaggaaccattggatcagctgccggaacgttgtttgctgcaggtcctggacgtattccgcatctggtgggttcatccacagggcggaaagggtacgttccggctcttgcagcaggtagtcagattctactgttgggatttgtcagcgttattgtgctgctgtcctatgcaattgcactactaaccgggtgttccctgccgtaaaactagtccagcgattgcagtcgttcgagcattcgtggatcacggtgggtgaatcccgcaaggggttgttgcttgtctagggcggcgatacccgccatttcttcatctgtgagtgtgaaatcaaagacatcgatattttcacgtagtcgtttaagagccttttgagaactcatcgacacaagcactcactgtgaaaaatcgatgccttaaaacggcaccggtgggttcttcagaacatacggggctaaaacccaccacaccctgcgcatgaacttttggtgaccaaccaagcggtacttttcctaccccggtagacacttaagtatctgaaaataatacctttaaacaggagaagtagtgtttctatccgcataccgcgcaccgattgccgcaggcaccgtcgtcgccgctgctctggcaggggtttctattgtccaggcgcaggaaaatatctcatagttcaacatcgcaaatatcaccgacttccacggctatatctctgcaactgcagctcaccccggtgcagcaatgctgaaatgtgcagtcgatgaagccgctggcggacgcgcccaagctttcgtatcctcaggcgataacattggtggcagcccgttccaatcctccattcttggtgatgaacccaccttggaagcactcaaccaaatgggtcttgattactcagcagtgggcaaccacgaatttgataaaggctacgcagacttaagcagtcgagtcgctgaccttgctgattttgattatctcggcgcaaacgttgagggcgaaaacccagatcttgcaccatatggaatttctcaccttgatggtgtgaaggttgctttcgtaggcaccgtatcccaagaaactccgatgttggtcaattctgaaggcattgagggaatcacgtttactgacccacttgaagcaaccaaccgtgtagctgatgaactcgtgggaagtggcgcagcagatgttgtcgttgcgctttaccacgaaggcattaccggcaccgaagcatggtcagaaaatatcgacgttgttttcgcaggtcacacccactaagttcgtgatctaggaaccgacaacggtccactaatcatgcagtctggaaactacgggcacgcacttgccgatgtagatttcagcttcaaccacgacaccggtgagctcaccgtagatgatgcccgcatgctcggagtcgacgatatcaacgcgtgtgaaaacccagatgacaccattgcagatattgttgctcaggcggaacttgatgctggtgaagccggcaaagaagtagtagcgaccatcgatggcgattttctccgcgccagcgacgaaggagcagaatctggctccaactacggcgctgaatcccagctcgtcaacatgattgccagtgctgtgcgttggtccatgtccaccaataccgccaccaccgcagacattgggcttatgaacgccggaggactccacactgacctattcagcggcgatgttacctacgccgaagcttttgaaatccagcctttctccggtgaagattcatttgtcaccctcaagggatcagacttcaaagatgcccttgagcagcagtgggaagaaggttctgcacgaccagtggcagcacttggcgtatccgacaacgtttcctacacctacgacatcaaccgtccaatcggtgaccgcgtcacttccgtgaccattgatgataccccacttgatccggaacgcgactacgttgttgcagcttccctgtacctccagtccggcaacgaaggtatgaccgcactgacccgcggaaccgcacctgcacaaaccggcatcgtggatgtacagtccaccatcggatacttgtccaacaacaatgtcaccccacgtactggtcaagcccagatttccatcaccccatccggtgagttcaatgcgggtgaaaccatcacccttgacatggcaggactccgctacacccaaggcgacactgccacggaagtaactgtcagccttcgagaagaaattgtttcagcaccaattgatcctcagctcggagaagctggctttggcgaagctggaaccgcgacagtgagcttggacattcctgcaaccctttcaggtactcaaaacctcgttgtcaccaccgataccggcacccgtatttccatgccagttgagattgttggcgcagaacaaccagcaccgcaaccagcaggttcctctgttttaggaactggagtgctcagtggactcctcggcattgttgtaggaattctaggaatggtcggtctggtgaactggattgacccaagcttcattcaacagatccagcagcaaatctttgcttaaatttagtaaaaagcatgcatctagctgcggatttttaagaaacgtagcctgggtgtaaaatttaaagagcaagtttttacaacttgctctttagctcggggcattagctcagttggtagagcacctgctttgcaagcaggatgtcaggagttcgattctcctatgctccacagttttcccggttcacctttgttggtgggccgggatttttacttgcttttacggcgtgtcgttgtggcatcgattccggtgtcataggtaaccgggcgcccgtagtggtcgtgtggttgttcttgttggatcaagtcggggacgttggcgagtccgtcttgaccccagttttgttgcctggcaatcgcgaccgggttgctgggcaacagcgtgaggattaacagctaatggcggagtcgaaacgtctgcatggtgggctagttacccctttaagctcgcgatttggtagttgcaactccaatcggtagagtttgggattgttcctaaaggggcctatagctcagtcggttagagcgcatcgctgataacgatgaggtcgcaagttcgattcttgctaggcccaccaggaacaaaaaaggggcattagctcagttggtagagcacctgctttgcaagcaggatgtcaggagttcgattctcctatgctccacagttttcccggttcaccttgttggtgggccgggatttttgttgtttagatttttgaaagcacacttttgtcccttaactagtgcgtgtgtacattcgacaccaagatttgggcaatatggtgcccaaaatcaggaaatcttgctgtctaatgcacaacggaaaactgctcacggacgaactagttgtagcgagcgtattctttgtgttctctcacgacaggaatactgctatggcgatcgagtccatcgcgtacaccagtgaagcactctcaaccggcagtggccggctggggcatgtgcgctccacagatggtgcgctcgaatttgaaatgacaccgccaaaggctttgggcggatccggtgaaggcaccaatccagaacagctgttcgcggtaggttacgcagcctgtttccactctgccatgcactctgtcgcacgcagccgcaagatcactcttgaagacacagcggttggtgcccgagttagcatcgggccaaacggcgctggtggatttgagattgccgtagaactcgaagtatcgattcctcaattgccacaagcagaagcccaggaacttgctgatgccgcgcaccaggtgtgcccgtattccaacgccacacgaggcaatatctcggtaactgtgtcagtcatcgacgaagaggcttaaaaccacaggattaacaaaactctcagtttctacactgagggtcttggtctttagagcgagggacgcgctacattgacctgaagtggtggaggtaggcgtcgagaagcaaattctttttgttcgctgacaccggtgagttcgttggtgggtcaagccttcaagtacgctcggttgcggcttgatggtggagcagttgcaaccacaagacctgcttcaacaaggccacgaagcagcggccgaagagacgatgcagttttccctgtttttgtggcaatttctcgaattgtgacaggagttgttttattgattgcatctaagacttcttgttcgctttgagttacattcacagacgatgtcgcaagctgatattggttctgtaagttttggtttagaacgccccgatcaaccaaagcgtcaagtaagctgcgcatgtcttctgaatcatgaccagtttgattgcggagatctcgagacgttaccgctccaagttcttttgcgagaacaagagcaatgccttgtgtgttagaaaaatctgatccgagtttttctacaagccattcacttgtttgggcatctagaagaccgtgacggctgagttcgacagtgacgctagaaatatcaatcttaaaattcggtaccggaagtcccgcttcacgcatcaaattgaacattcggggaacgccagtaccgttgctttcagcaagtactccttgtacttcatgtgtccatggaatatccattaggattcttgaaagcacacgatttcttggttcagagtatccgtccagtattgactctgggcgtttaccattgggtaatccacctggactcgtgatctcaactcgatccttatagatgtctacatgaattgcttcattttgagctagctcagaataatcacggtgaagtacggcgtttgctagagcctctctcaaaacttcttctgggatttctagaacatctttacctgagagtccttcaacgacgcggcgtacacgtaggtttcgtttgatggcagacatagcctcttgaaccatctcgagaagatttccctcgcagatttttcggtcttcaaaacgaattgaggtaccgattggtgacttatgcagacctggatgtacggcaacatcaatgatcactcgggggaaaaactgttgaggatagcttccgagagccagtaagccagcaatcgtcagttctccctttgatgtagtgatatttttgcgcagtaaccagttatcgtctgttccaagggagcgactatttgactcaattaggcgctgcttaaatgacgccgcgagctgattgttgagatcgtcgatgcttgaatctggaactggatttctatctgttttggtttgaacaaacctattttggagctcgtaaatttcaagatgactgagcttccggtcttcatcgccaacgcgtttgaagctgccattagtgattccgacgggaagataataacagggcccgttcactgacaacggtgagactgaaactaaaacaacttcagcaccatcaacagtcatttcatgaatttcatgatggggcactggttccactttttgggcgtcgcgatcttgtggatttaaacctgcacgaatgaactggatactcgcctgtgaatcaaatccttcaactggagtgaaatctggttcgcttagccccaataggatgtatccaccgttggtgtttgcgaatgcgcttaatgattcccagaagctttttgatcctttgcttaaaggtaaccgaccccaagatttcacttctacggtttcatcgtcttttccgtttttcctaagacgctcaaggtctttctctaattcgaatggttccacggtggcgagtgccccacaatctattaaacgtattaggtatccctgtcagtctacttcactgagaccctcagtttctacactgagagcgtcactttatacactgagaccctcagtttctacactgagggcgtcactttatacactgagaccctcagtttctacactgagggtcttagtttttttagtgaggagcgcgctacgttgacctgaagtggtggaggtaggcgtcgaaaagcaatttctttttagccgctcactccggtgagctcgttgggggttcctggcagggtggcgctggcaaggatgttgccgttggccaggtcaacaacatggagttcgttgtttgatgggtcggagacgtatgcgcggtccttgttgatgaacagggttgggcgtgcttcttgccatacttctggttcggtccaggcatcgatgacggggtaggtgttggtgatggcgccggtgttggcatcgatgatgtggagtgcgccgtcggtgcctagaactactgcttcgcctgcagggccacggccaagtgagcggaaggagtaggaggtgccgaggtcaacgagggtgagctcgccggtctcggtgttggtgagggaaacgcgctctgggcgctccaagtcggcgtctttatctaccttgtaatcgccgaggacgacaggagagacgtcgctgcctgattggttgccgatgcgaccgtaggaatcaggtgcctggaccttggtgaactcgccgtccttgtagatcagtacaccgtcttcacagccaactgcgatggcgtcaccgagtgctgcgctttcaccgtgaacgccggggcactgttcgttgcgggcgatttcttcaccggctgcgttgaatacgacggcgccgttgcgggaatcctcatcgcccaaagtgtgcagcaggtcgccgttttcgaggactactgccacgccgtggtgggctttgagggcgtttttgatctcaggttctacttcatcgcccttgaggagggaagcggtgtcgaagatctggattttgccgtcaccatcgccgaacagcacggtcttgccggcgtggttcactacatgaccaggcttatcggtggagtaggtgatgtcggtgagttctggggtggcggtgtagctgtgggtgtgatcgccgtgtggttcggtccatgcgccggtatcaaagagctggaagccgccacctgtggagacaaatacgtggcgtccgtctcctgcactgttgaggcggttaaaacctgctagttcggtgtcttccaggatttccagagtgttggcgtcgagggtaatgatgccaccgtcgtaggtggtgacgatgcgggcctgcggggaggacacctcaacggcagtgctgctgccttcggcttcgtggccatcatgatcgtgtgcctcggagcttgctgttgcagagctagacgcagttgcagtatctgcagagctgtcagtgccacagcttgccagcaggatagatgcggtggataccgcagcaataagaagtagcttggagtttttcatggttctccttttagtaaaacatttagtaaaacggggactgtttaagactgtttaggactgtttaggacaaagtgcttgcaatgcgctcggcattgattttttgcatgctgatgtaggtgggtgcttcaccatctgcatcggtgagtgattccgtgaaaatggacaccacttgaacatcaatgccagcgttgctggccaacacttcagctaaccgttgtgggcttgaggtatcggtgaagattgcgggaacattgttgtcttcgatggcggtggagatgtcattgaggtcagatgctgaaggcgccgccaatgtgcttccacctgggatgatggtgtcaatgacggtgtagttaaaccggctggccaggtatccaaaaacattgtgattggttaccagcttgcggttttctggggccacgccgctgagcaattcggtgacttcctcatcaagggcaacaagttcctcacggtagtgctgggctgattgtgtgatcgattcagtcagggaaggatcgagttctttgatcagttcagcttctataacttccgtggcggcgatcatgcgcgccgggtctgtccaaaagtgaggatctggaacgccgggggagtagtcaatgacatcgatgtgttcgccgacttccaagacgggaaccccttggcttttggcattgtccacattggattgaaggccctcttcaagtcctagtccattggccacgatgagatcggcatgttccatggcagcggcgtcttgtgctgagactccgaaggaatgtggatctgcgttgggtttcatgagtacttggacatctgcggaatctcccacgatatggcttacaacatcacccaggatgttggtggtgaccacaatgtcaggggtgtcatctacagcggaacaggcggtgataccaaaagctagtgaggcggcaacggctggaacagctagtagttttcggaaatttttcgcggaggaagccccaaagagctccccattattgaaaatgtctttcagtatcacgcggtgaagtttaacctactaatggcactctttgtcaataaggtggcaaaaaatatcgcagcacttaacaaagtgatagtggctcccgcggcagtgcttgcgtgccagctgattaaaagcccgaggtaaatttccgcgcatccaagaagcgacgcgacgatcatgatcagtgaaatacttgctttgtcttgcactaaaagtgcagccgtggcgggcggaccaatgagaagtccaaacactaaaagcgttcccaccacctgaaacgacaccaccgtagctaatgcgatcagtgccagcatgagtaggtgtgcaaagcggggattgagtcctaaggtgtgagctttacgctcgtcgaaagcgagtgcagtgaactgtcggtggaagagaaaaatagtcaatccacccaacactgttgcaatggcgatgatgaatatatccgagggtcgcacgccaagaatgtctccaaaaaggaaactggtgaggtctacggcgtgggaatcggagtgggacacaataaccacgccgagggaaagcatggtaataaattgcaggccaatgctgacgtcttgggagaggctggattttctgctggtccacaccactccggctgacatgattaatgcgctgattgctgcgccgaacatgagatttccgcccaatagtgatgccgtggctactccggggagcaagccgtgcgacatagcgtcgccgaaaaaggttagcctgcgcaaaataacccacgttccaatgagtgagcataaaattgcggccaggcatccggcgaccagggcgcgggagatgaatgaaacgtcaaaaggcactatgagggcgtcagtaaaaaacttcatttgaaaatgataaccgttatcattaaggaatggcagaactcagcgtccggaatctcacatgcacatacggcaatcacatcgcgctcaacaacatcacggcacgcttcccaaccggaaaaataactgccctcatcggcagcaacggctccggaaaatccacactgttggaaactttggcgggcatgctggcaccccgcagcggaagcattaacaaccttgtgccagaaatcgcgttcgtcccccaacgcagccacgtctcccataatttgcccatcacgatcagacaaacagtcagcatggggcgatggtcagccaagaaaaactggcaacgactcactgccgcagattgcaacatcgtggacagctgcctcgaccggctcgaaatctccggcctcgccgaccgccccctcggcgaagtatcaggcgggcagcgccaacgcgccctcatagcgcaaggtttagcgcaacaggcgcccttattgcttctcgacgaacccctcgccgccgtggactcccacgcggcaagtcttatcgaagatgtcattaaccaacaacgcaaccaaggaaccacaattattcttgcgactcacgatcttgatcaagcacatcaagcagatcagattatcgccttggaaaaaggaatcataaagccacagcgcaaagccactgaatcaataaagaagcgttaataaagtttgacttgtgcctctgacctgcgttgacttgagtaaatgaagctaccaagactcgccgcagcgctcattggtgctgcgctgttaatcacgggttgttcagctaccgggggagcaccacgggcaacagatggggcatcaggcggaggaaccgtcgatacgcctcggttggttgtcgcgatggtgagccacggcgcgccgggcgatactttttgggatttggtccgaaaaggtgctgaagacgccgcccaaaaagacaacgttgaactccgctattcctctaatccggaaatccctgaacaatccaacctcgtgcaaaatgccatcgattcacgcgtcgacggcatcgccatgaccatgcctaatgctcaatcactaggaccggtcgctcaaaaggccgtggatgcgggcattcctgtggttggtctcaacgctggaatgaacgaataccaagattatggaatgacaggattctttggtcaagatgaatccgtcgcaggagcatccgcaggagcgcgccttgccgaggaaaacgcacaaaaagttttgtgtgtgatccatgaacagggcaactcctcccaggaagctcgctgtggtggcgtgtctgaaggtttgggcaaacaagtagaaaccctgtatgtcaacggcatggatctcacctcagtgaactccaccctgcaggcaaaacttgctcaagaccgcagcattgattgggttgtgggactccaggctggtgtatcaatggctatttctgatgcggcagacgctgcgaactcagaagtaaagatcgccacctttgatacaaacgcacagctcatgaccgctattcgtgatggcaagatccaattcgccattgatcagcaaccatatctgcagggctacatggccgtggattcgctgtggttggcgcaccgaaacggcaccactgttggtggcggacgacccgtgtacacaggaccagccattgtggatgccaccaacgttgatgtcattgctgaagccgttggggagggtctgcgatgacaaaaatcaagagtggggaggcgtcgacaagcattgttgagcgcgccttaaagcgccccgaactgaccagcctgcttggcgccgtgcttgtttttacgctgtttatggtggtcgcgccggcatttaggtcatgggattcgatggcgaccgtgctgtatgcgagttccacgatcggcatcatggcggttgccgtgggcctgctgatgatcgctgatgaattcgacctgtccaccggcgttgccgtgacaactgcagcgctggcggcctcgatgtttagctataacctgtggctgaacacctgggtgggcgcgctgattgcattggtgatttcgctggccatcggctttttcaacggctttttggtagtgaaaaccaagattgcatccttcctgatcacccttgccactttccttatgctgcagggtattaatctggcggtcaccaagctgatttccggcaccgtggccacgccaaccatcgcggatatggaaggttttccttcagcgcgtgcggtgtttgccagctcgattcccatctttggtgtgaatattcgcatcactgttttttggtggctgctgtttgttatcgtcggcacttttgtgttgtttaagacgcgcatcggcaactggatttttgcggtcggtggcgatgaagaggcagctcgcgcagtcggcgttcccgtgcgtggcgtgaaaatcggcctgttcatgttcgttggttttgccgcctggtttgtgggcatgcacaacctgttcctctttgattcgattcaggctggtcaaggcgtgggtaatgagttcctctacatcatcgctgcggtgatcggaggcatctccatgactggtggccgcggaacagtggtgggcacaatgattggtgcactcatctttggaatgaccaaccaaggcattgtttatgcaggttggaaccctgactggttcatgttcttcctcggcggcaccctacttctggctgttttgctcaatcaccgattcgagcgtttcaacaaggagcgatcatgacagacctcattcaactccgcgaagtatccaaaaaatacggtgctttccaggccctcaacgacatcaatttgaacgtccgcgcaggcgaagtcacctgtgttctgggtgacaacggcgccggaaaatccaccctcatcaagattctctccggcctgcatcccgccacctccggcgaagtaatcgtggccggcgatgtagtgaattttggatccccccgcgacgccctcgacgccggaatcgccaccgtctaccaagacctagcagtggtcgggcagatgagtgtgtggcgcaacttcttcctcggccaggaactcaccggccgatttggcgttctgaaacaagaagaaatgcgccgcatcaccgacgaacaactccgcgaaatgggcatcgaactccgcgatgtcgacgtccctgtggcctccctttcaggtggtcaacgccaagttgtcgccatcgcccgcgccatctacttcggcgcgcgcgtcctcattttggacgagcccaccgcagcgctgggcgtgaaacaatctggcatggtgctgcgctttattgccgcagcacgcgaccgggggatcggcgtcattttcatcacgcacaacccccaccacgcctaccttgtcggtgatcacttcatcctgctcaacttaggcaagcaggtcatggacaaatcccgcgcagaagtcgagctggaagaactcaccctcgccatgtccggcggcggcgagctcgactcactcagccacgaattgaagcgttaacctacttcttcttttcgctctgggtgcgctgaggtgcattcttcttatcaaactcagcctgaatggcctcagcttccgcctcttctgccgcttcctgctccgcatcggcctcagcctcgagctctgcctctagttcagcttcggttttggcttcttcttcggtggtttctgctggagtttcggtggcctcagctggggcttcagtggtttctgggctttctgtggagtacaccaactctggctcctccacagcagcctcagccacaacctcaggctcatcctgctccacggccttcttcaactgaacctcaacccgtggaggctgggtgcctggggtttccttcttggtcttgttcaaaaacgcgtaggccaccgcgacgatgccggaggtcgctagcgccgccaacgacagattgcgcacccagtgcgactccttcttttcagtcgccttgcgggctgccttagcggccttgtctgcttttcgacgcgccttccggttcaatttcttgcccgattcacgtgcgtccttcaacgcagaagtgccctgcttgtcagcctcagcgagcgccttttccagacgagcacgagcagccttggtgacatttccagccttatcgcgcgactcagtataaaattccttcgctgattcccgcgcagtctctacagcctgctcagcttttggtgcatattcaccagcagcttgggacaacgcatcataagtctcagacaccttgcggtcgcggtaatccgcataagttccataagctttacgtgcgccatccactactaacttgaggttgccaatcgtgctcatattcaactctccttaaattggtcgcgttcttctaagaccccacattagtaaaagcatgggacatgtggttggcatttcgctcgatgtagttatgatgggcgttatgacttctaagaccgcaactgcgattctgcatacaaatcgcggagacatcaccatcgacctgttcggcaaccacgctccagagaccgtcgctaacttcgttggcctggcacagggcaccaaggactaccagtccgcaaacgctcagggcgacagcgaaggtccgttctacaacggatctgtcttccaccgcgtcatcgacggcttcatgatccagggtggagacccaaccggcaccggccgtggcggccctggctacaccttcgctgatgaattccacccagagctgcgcttcgaccgcgcatacctgctggcaatggcaaatgcgggcccaggcaccaacggttcccagttcttcatcactgtgaccccaacccctcacctgaacaacgctcacaccatcttcggtgaggtcactgacgctgagtctcagaaggttgtggatgcaattgcaaccaccgcaaccgatcgttacgaccgcccagctgacgcagttgtcatcgagtctgtagagatcaccgcgtaacagccacctctacgtacactaatcttcaggttatgccgcaagccggtatgacctgatttttttatgccacaaaaacctgttgaaagaccagttgaagattgttggattcatgaatgtagaacggatttatcgacaagcgccagcaagtacgttgatctctttagccatcatcgctgtgtacgcagtgacggccattcaatcgagatcagtgacagacaacctgggttcaaccagtatcggtgacgcgtggattctgtacgcaccgctgatggatgatggtggctttggtccactgcgtgccatcggaggaatgttcctgcacattggccccgggcacatgctgttgaaccttgtgttgttgtggttgctgggaagagaaattgaacgagacttcggttctgcgcttttcactgcgatgtactttgtgggcggtattggtgcgtctgcagctgtcatctggatggatccctattcaccgacagcaggtgcttccggcgccatttacgccatgatggctattttggtggggctttttgtgttaagaagcgcggatatccgagcacccttgatccttatcgccatcaacatcgcctataccttgatgtccaccaatgtttctctgtggggacaccttggaggtttgatcactggagctttaattacttggccaatggttaaagcgaaaactcaaagaacacggtggattatcgtgctcattggttttgctgtagttgtggctgctgtcattctaggaattgaccgggtgtagacacattccgcccattgccctcaccggggtcaaaaatttgacatccggtgagggtatttctgtatctatcgcttgacaggaattgaactaaattacaattttgtaattcaccgagtgaattaaccccgtgttagcttttccacagaatgtgtaattccaagtttcctctttgtacacataacaacattgagcttcccacacgcctgtgcacagttctgtggatgaatgtggataactcacaacagttcaagttatccacaaaagttatccacactgtggatagttacatttttgtaatttaccgatacattgagccaatttattattcgaacacgtagatggcttggaaacactgacgtcagcacctgtactattcgaacaaatcacaacccggtggaaactgttcacagagttatccacaggctgtgaaatggtaggtatacctgacagtgtcagtctaaaactgttccattcacaacttgttccacagcctgtggataacttgaggaaaagcgattaacacacacttgtccacagatcgatgtgtataactccgaacccctgtggataactcagggggtagggatgcgcgcacagtcagcttggtactgcatcggtgtgcaaccatgagtggcggtgaaagcacggttgaaagcaggtaagtgtgagtatccgaggttccgtgcgactacccccgggcttagccctttgcttaattgaatgcgcgccaaagtcattcttcgcagaagtccccagcgctgcaccgcaatgccagtcatgtgtgcaaactcttccgcaattccgccgcgaatagcagaaacattagtttctcgggagactgcaagatcaactgccaaagaaattaattcatcattgtgatttttggttggcgtgtttttcgtggagcattttggaaaaggtagggagaagcactgatccggggccgctttgtgcgggtgaaaaggagtgtaggcagaaatcgtgcattgcaaaagctgctgaatagagcaatcaaactgaatgatgtccacatgttgggcactgattgaatgggaatctggaacttggtagcccaacggcaacatgagtccgcccgcaggagtgtgaagatccaggcgcattccagctggaagaattaacccttcaccttgatgaacagtgagttctctatcagctactcgaacggtggatgttccttgaaaagcccacaccatgatgtgagatccattgatccgagaccatgtttcatttgctggaatctctaaagatgcgagttggggcagtggtggatcaagatgttgcggttctggaagtgtaagaatctgattgggtgagatccccatatgagtgcgaaatgctttggagaggttgcttgctccagaaaaaccaacgtgatgagctgcccattctgcgctgtcgccatcggaaagataggcaactgcaaggcttaaccgggtgcgtgttctccaggtgctgatgtttagccctgtttcatcgagaaaacggcgctgtgaaaagaaaccagacgattcgggttgcaaagctttctgtgcagttccgtccccggacactgatggtagtgctcatcgcggttacgttggtggtgattcttattcatttgagtctgactgttggttccatcactgcatcgcaggcgtggtcggcggtcgtaggagtgggtgatgcttctgatattcgttcagtgcaatcacggcgcttgcctcgagtgctgacagcggtaggagtgggcgctgcgctgggattatctggcgcttgtttcagtccgtgtcacgtaacagtgctgggctcaccagacatcattggatttaccacgggagctgccacagctgcggcgatcagcattattttctttgatgcaggtgtggtcttaaccggagtggcagccattcttggtggacttgcgaccgcagtttttgtctatctcatggccagacaaaatagcaataccggcgggttgcgtctggtgttggttggtatcggaacaggtgcatttttgggtgctgctcgtgatttcttcatggtgcgcgcagatattacgggtgcttcgacggtacagctgtggtctgccggttcgttgagcgggcgcgactggaatcatgccctgttggtgttgatttcgtgtgcagtgattgtgccagcactgtgcattattgtccgccgtttacgcctgatggaaatgggtgatgatgcagctggggcacttggaatttcagtggagagaacacggttgatagccattttgttggctgtgctgctggtggggatcgccaccgcagctgcaggtcccatcgcttttattgcactggcagcacctcagattgcccgggctctggcccgggaggatggagtgctggtggctgcgtcgataagcattggctctgggctgttagttgcggcggattgcctagagcaacacgttgatactgagctgcacacgcccgttggcctggtgaccagtttgctgggcggggtgtatttgatgtggcttttgagccgaaaggaggcataaatgctgcaagcgcatgatctcacgctgagttacggcgggcgaaatattgtagaagggctcagtctggaccttccggaaagaggcctcagcatcatcattggccccaacggatgcgggaaatcaaccgttttgaaagcgttgggcagactgctgaaaccacaattggggaagatcacgctaggtgggcgagatatttccagcatgggcaccaagcatgtggcgaaacacatcggggtgcttccgcaacccccatatgcgcccgatggggtgagcgtcacggagctggtcagccgcgggcggtatccgcaccaacatctgctgtcgcaatggtcaaaagacgatgaagccattgtggcgcgctcgctggcggaagtcggcatgcacacccatgctgagcatttagtgtcggaactttcaggcggccagcgccaacgggcgtggatcgccatggcgctcgctcaggaaacagacattttgcttctcgacgagcccaccacgttcctcgacgtagcccaccaaatatccgtcctcgatttatgctccgacctgcaccaacgtggtcgcaccctggccattgttctacacgatctgaacatggctgcacggtatgccacccacatcatcgccatgcgggacggcaccatcatcgaccaaggaaaacccgaagaaatactcactaaagcgctgctcaaagaagtttttgacctcgacgcactcatcctcaaagaccccaacaacggccgaccactcatcgtgcccacagacaggagaaactcatgaaagaaaccgacaacctactgcgcgaaaactcccacgaccgcgacatctctgaaatcgtcgccaccatcactgcccttgaccacccatcaccctcacttctgcgattcacagcttttgttccaggatcagcaaacaacccagtgtgggcagaagccaacgtggcaatcaggctttacctcagcgaagaattcgacgacgccacccgcgtctacaccgtccgatcctttgatgccgcaactgaaagcatcgtggtggatgtggttcaacaccaccacgaaagccccatgatgcgctggtcagacaccgtaaaaatcaacgacaccctcgtgctcaccggaccccgcccacactttgtcatccccgaaggcgaacaagcagcactcttccttgatgacaccgccatccccgctctcgccgctattttggatcaatggccaacagatcttcgtggcaaaggatgggttgtcactgacgatcccgcagccttcgatgaactacccagcatcgacggactggaactgaacctgctcgcgccgggatcagatccaactgttcagccacttgcccaacaggcatatgacctggaaaacccagaaacttacgtggtgtgggcagccggcgagcgagatgaaataaaatccatccgcaggcacttccgcaagcaggtgggattggaaaaagatgcagtggccgtgtttgggtactggaaatacaacaccaccaacactcagatcgatgcagtccgcaaagaaaactacatgaagatgctctctgaagggctacagctggaaaacttcgacgacctctcattggagatttaaggggtcgagtttttagaatgggtgtttgcattgattggcgtctgatgagctcttagaagcgattctgggagggcatgatttttgggattcggagctgaatgtggactgattttgggggaaccagactggcgtgcccaaatgtcgtgtcttcagtccacatgggcatgcctgtctggtttctcggctctcaaaccgaacaggagtgcccacggctggcaaaaagttcagttcttgggcacgctagtctggttttacctttttgagtgccccgaactgccaaacgagagtgcccatgaggggctaaatctggatccgcccgcacaaaacaactgccgcagcacaacgaatcaacgctgtgctgcggcagtcacttttttgaaggattaacgccaacccatggtcatgagtaggccgatgatcatcagaccgaagccgatgccatagttccatgcaccaagatcagccatgaatgggatctgtgggcccacgaggtagttaatgatcaaccaggctaggccgacgatcatgaaggcaaacatgatgaccttgtaccacattggggttccggcggaattgatcttaaccggggtgcggtttgcgcttgggttgcttgaaaccggtgcggtctcgtttttagttactcttgcctttggcattgttcacaccttcataatttattgtcttggaaaaaccccagcaactggtacttatcttgtttgagcttaacgtatcagttgccgggccagctaccttgacggtttccttgttggctattgcacgagtgcagcgagatcgaattcgaagagtcgcacttgcacttgggcgtctttgcggaagagggttgcaggggttggggattggaatccgattttgttttgatccacgagggctgcggtgtggatggggtcgccgacgatcagggattgatctggggcggtccagccagcagcgcggagggcactgatggcctgttcggtggacatgcgggcgagatcgggggcttggatgagcatgccgttggagacttccactgtgatggatgaacccttgggtagttcagttccttggctggaaactgagaggacttcgccttctggttcgctgctgtctaagtaggaagctgtggggttaaagcccatggagatgaggttttgttctgcttgtgaccagttcatgccggtgaggttgggcactcggatgctctcggtgcctgaagacatggttagagatacagaggaacccacgactacttcttggccggcttcggggttttggtcgatgacgaggccagattcgacgtcgtcggaggtttcttcccgaacgttttggttgagtatgagaccaacgtcttcgagggcgcgggcggcgtcctcaagtgtcatgccggagacgtctgggatgttgatcatttctcggccggtggacacggtgatggtgacggtggccccttggcggatttcggatccaacgcttgggtttgctcggatgacgaggccttcggcgacgtcggcgctggcttcttcgacgatgttgacaacaaatcctgctgcttgaagttctgtgagagcttcttgctgcgggaggccttccacattggggatcgcgctggttgcagtggaggagctgttggcaaagtagtcgtaggtgaaggcaccggcaacgccgacgacacctagggataacacgatggccagggcggtgaggcctctggatccacgtttacgcgaagaagaccctgaccccgtactggccgcagccacgcctgcggcgggggccacttgggtggaggtgcgcgtcgagaagcgagtttcgggctcttctggggtttcttctgtttctacatgcgcgcgtgcggcatgggagactgcattgcgggatagccggcccaggtcagcggccatttcggaggctgtttggtagcggtcggcggggtgttttgccatggcggtgagtaccacggcatccacgttgacagcagaggtcggggtgaggtccgcgatgaaatccgaaggaggggtggggtcttcctggacgtgttggtaggccacggcgaaaggggactcgccttcaaaaggtggcttaccggtgactaattcgtacatgacgcagccggtggcgtaaatatcggaacgcgcatcggcgggtttgccgcgggcctgctcaggggagaggtactgggcggtgccgatgactgcggaggtttgagtcatggcggaggtggaatcgttgaccgcgcgggcgatgccgaagtccatgactttcacgccaccggtgttggtgatcatgatgttggcgggtttcacatcgcggtgaataatgccggcgtcatgggatgcctgcagcgcttcacacacagggatgaggatgttggctgcctcaactggggtgaatacgccgtcttcggtgacaacttcgcgcaggtttcgaccctgcacgcgttccatcacaatgtagggaacagaggtgccgtctttgtctacttcgccggtgtcaaaaacagcgacgatcgaagagtggctcaaccttccggagttttgggcttccctgcggaagcgttctcggaaattgggatctttcgcaaggtcgatgcgcagcatctttaccgcgacctcccgaccaatgagcgtgtcggtggccgcgaacacctcgctcatgccaccggagccgatgacggcatccagttcatagcgatcagcgatcacgaaggtcactgcgctcctcctacatccaataggccatttacggcgtcgattaaatcatcagccggtgcattagtctcaactggaacgctagcactcgtcctaggtgtagaggtagggatttgaggcacagttcggctacttgttggagcttccgtggttggttcctcggatgtgctctcttcacttgtcgtcggacggtgtgaagttgtttcaggttcggtgaatgttgaccgtgttggaggcgttggcggtacccactgagaggtggtttcctccacggttggggtgtatgtttccgtaatggtttcaggtgtggtggtttcttccggagtgtcgttgaacaaaattccggtggtgcccgcatagatcaccgcgccaataatcacggcaagcaaagctgcgatgaacagaccaatgccaatgccggaaccgcgtttcggggccgcttcttgggtgattgttgcaggccgggccaccctgcccagcatcgccgttgattcgcttggcgacggcgcctccgcctgcgccatcatcgcgctcgtgcgcggttgaggcgggcgcttgccaaggcgcacagcagaaacagctagcgccatttcatttccatcagggaaacggcgacccggatccttgcgcaacgcaatgccaatcaactcgcgagtctgtgccgaaatgctggtgggcatctgcggcggagcttggttgatgtgcgcgatcgccacagacaccgaagaatctccagtgaacgggcggcggccagccatcatctcatagccgaccacaccgagagaataaatatcagaagccgcggtgacttccttgccctgggcttgctcaggtgaaacatattgagcagtacccaccaccatgccggtgcgggtcaaaggcacagcagcggcagccttagcgataccaaagtccgtgatcttcacaatgccattggctgtgatcagcatgttgcccggcttgatatcgcggtgcaccatgtccatccggtgaatcaccgacaaaccatgtgccgcctgttccatcacatcaagagccaggtcttccggcagtctgccttcgcgctctagaagatccgcaagcgattcaccgcggacaaattccatgacgatgaagcagaaagtatgcccagcagggtctggaacctcacggtagtcataggtggccaccacgtgttcagaatcgatattctcagccgcttgcgcttcattgcggaaacggttcaagaactcctggttgtcggaaaattccgggcgcagtaccttgatggctacttcgcgatcattgaccacatcatctgcgagccatacggtggacatgccaccgtgtccgatgatccactgcagacgataatcagcgccgatgagttcttggagtcgatcttttccagtgatgtcttcttgactcatattttaaaatcctccggctgcctgaagcacagctcggccaattggggctgcgacctgaccaccagttgcactggtgccaaatccaccgccgtctttcaccaacacagcaacagcaatgtcgttgttgaatgccacgtaccaggtgtgtggtggtgtgttttcatcaccatgttccgcggtaccagtcttggaagcgatctgaattccggtgtagcccgaagtattgcgctctgaggcttccatcaaagtcttcaactgttctgcaatttctggctcgactccaccaactgatttcggcttgtgggtgctcagttcgctcaggtcctgaccggtgacgcgggataccaaatatggttccatgcgtacgccaccgttggatacggttcctgccatgacagcggcctgcagcacgttcatttgcacgtcgcgctggccaatgctggattgtccaagggcggcatcgtcggggatttcacccaagccgccaggaacgttatctagtcccaagctgtaggtttgtcccactccgaagtcctcggcagacgcgcgcaaagcatccgcgccaacatcaatgccggtctccacaaacgcagtattgcaggagagctggaaagcggtgagcagggtagtggtgccaccgcccgcacatgtctgaccgccgtagttggtcaaggtggtgttggtgccaggcagggtcactgctgcctctgcagtcacggtggaatcagcagagtagccgttttccaaagctgccgcagtagtgatgatcttgaaaatagatccaggaggcagtgattcctgcgttgcatggttgagcagcggtgcaccttcagtggaggtgtactcagcccaagcgtcctctgcggttgctggatccacgatctggttggggtcatagcttggcgatgacgccatggccagcacctcaccagtgcttgggcgaagcgccaccacagcaccctcgtagccgctttggctcagctgttcataagcagtttgctgcgcattgggatccaaggtcagctcaatgtttgcgccatgggtagggctgccagaaatgacatccagccactgggaggtaaacagggaagagtcactgccgttgaggatagagttgtatcccaattccaggccagctgctccataaacatcagagaggtaaccaaccaccggtgcgtaggcagtcgggttggtgatgtagctgcgctggtaaaaaccctgatcgtcctgggaggactctgcgagtacttggccaccagttgaaatctgtccacgcggagtggacttcgcctccaggaaaccacgtgcgttcagtgggttctgagcaagatcatcgtccctaaaagcctgaatccaggtgaggtttgctacgagcaccaagatcaggagcaaagagaagagggatgtgattcgaatcgagcggttcacgcagccacctccgatgcttgcttggacatgacaggtcggcgggcactgtcagaaatacgcaagatgatggccatcagaatgtagttagccatcagggatgaaccaccctgggacataaacggagtggtcaaacctgtcatgggcatcagtgaagaaatacctgccacgacgacgaaaatctggatcatgatggtcatcgacagaccagatgccacgagctttccgtagctgtcacgagccagggtagcggtgcgcataccgcgggtgacaaacacaccaaacagcacgatgatggccgccaggccaatcagaccaagctcctcaccaatggctgcgagaatgaagtccgagtgcacgacagggatcatgttggggtaaccctgaccaatgccggtgccggtgattccgccccaactcatgccaaacaaggactgggacagctggtaaccggtggtgtcatagtgggccacaggatccacgaagttttgcacgcgttcctgaatcttgcttgaaacttggtacaccgcgaacgcgccgacagccaccaacacagcaccaatcaacagccaggaaccacggccggtagccaggtacaccatggccaaaacggtagtgaaaagcagcagtgcaggaccgaagtcgttggcgccagccatgatcaaaatagccaacgcccacaccacaagaatcggcgcgaggtcacgcaaacgagggaaatccatgccgaggaaacggtagcccgcaacagtaaacaaagcacgcttggtggctagcagctgagcaaagaacagcagcagcaaaatcttggagaactcacctggctggatggagaaaggtccaagccaaatccagatgcgggcttccacgccgcctggctgcggccacacgagaggcagcgccagcagcacgatgcccaccacaccgaggaggtaggaataacgcgaaagcgacttgtaatcacgcaacagcaacaacacagccaccatcagcgtgacgccaacaaccgtccacatcaattggctattgaccgtgctgtagcccgtggcctcatcaaggcgataaatcatcaccaaaccaatgccattgagcaccgccaccacaggcagcatgatttgatcagcaaacggcgccacccatgccatggctaggtgcgcgacgatgaagataccgatatatccgcccatcagcatcaaaatatgggtacccaactcattgcccatggccagctcgaggctgatgaacatgatcgacacaacgagtgtggcaagtatcagcagccacatttccgtgcgacgaagctttaatcgttcaagcgtgttcatgagacctccctacaattgactccgggttcgtttctatcgccaccggttgttacttctaagttcacgcacactggcaaagcttgagcagccagccgttgcatttgcgcctggacctcgtcatacgacccagacggtaatcctgcgacactaccgcgaacagatgccggtaaatcatccaatttgaaagacgtaccgttttcacaggattccttgagtgacaaggtgccagcttcattcaggcacgccacctggaattgcgaatgtaaatccttgccaaagatgcggtaatccacaccgtgttccacggtgatggcttcctcatcattgaccgcgacgtaaaaagtgctgtcaatacgggagtagccccaccatcctgcggcaactacaccgatgaggatgaccagggctacgatcaataccgcaagtttgctggaacttttctctggtggctcctcaattgtgggaatatcctccgttccagcatcagatatctttggtgccggatcaatcacttgagctcgccgtgtgatcgccgcagcgcgtcccgcagcggtatcaggccgcggatcttcaggctgctcaccattgagcgcaccagccgtgacaggcactgatgcttccgctgctgcttccgcctcggtgacttctacaacatcggccacaatgaccgtcacattgtccggaccgccagaacgcagcgccaactccaccaacttggtggacgcatcctgcggggtgcctacacgcactgtttcttcaatcgtggagtgtgtaaccggatctgatagaccatcagagcacaacaacaaacgatccccaggcaaggccgggaattgctccagagtgggctccacaggatggccggtgtaagccttcagaatcaaagaacgctgagggtgagttgaaacatcttctggatcaagcttgccctcagcgaccaacgactgcacaaaagtatcgtcgactgtaacctgtaccaacttatcgtcgcgaagcacataaccacgactatcgccgacgtggcacattgccaggtcacgcccgttaaacatgaacgccgtcaacgtagtgcccatgccgtcgcgcgccgggtcttcggcgatgccctcagcaatcgccgcgttggcttcgcctgccaccatgcccaccagcgccaacatatcgttatcaccaggatcaacatcaagcgcacgcaaatggttgatcatggtttgggaagcgatctcaccagcagcatggccgcccataccatcagccagcgccaacaaatgcgggccagcgtaagcggaatcctcattgttcccgcgcactaaccctcggtcagatgccaccgcatatttaagtttcaacatcagggaacaagcctcactgttgtacgaccaatacggatatccgtgcccaccgcaatctgctcaggctgatcaatgcgcgtaccaccgacaaaagtgccgttgcgcgaatccagatcctccacaaaccactccgaaccacgcttaaacacccgcgcatgcatgccggaggcgtaatcatcgcccaccacaaacgtgcactcagggctacggcccatcgtcatatcctccgacacctcaatcgaggagcccgccaacgggccctcgaccaccgtcaaaagacgaggcgggctggagcgattaaaagcccgggcaaggccctgcggtgccgcgacggaggagctgcttgtcgacgcttgacccgtcactttcaaatctgccctcatagcgcgcagcgccatcaagacgaaaaaccacaacaccacaagcaaagcgatgcgaagcccaagaaggaccagagaatccattgatcaacctctccctctagggactaacaatacgaacttcgatattggaatgacccaccgtaatgacatcaccatcagccaacaaccaattatccacaggagtgtcattcaccgtggtgccattagtcgacttcaaatcaaccaaaatggcatcccggccatcccacgtgatctccacatgctgacgagacacaccagtatccggcaaacgaagatccgcatcattactacgaccaatgatgttcgaaccctcccgaaccaaataagtccggctcgaaccatcctgcagcagcaaagtcaccgtagggcccgcgggcttcatcgcagcctggcgattcgcatcaacctgagactgcggcacaccctgaaccaaagggcgatccgctgattgcgccggcaaaaactccgtaccagtgtaaggggaactgtcagacacgttcttagactcactttctgcgacaggcaggatgccgtcgccttccaaaggcagataaccgctacttaactccggatccggatccttctccgaaaccgacttcaactggcccgtgtgcaacgaagaatcctcttcaatcaacacaatcaccggcccaaccaacgtccagccactgttcctgcagaacctcatcatctgatcaccaaaacgagccggctgatcaggaaaacgatcgacaagattactaaaatcgttcgggctcaccgaaaccttaaaaacattcggcgcctcaacatagccaaactcagtatgaaccacattgtcctcagcctcttgcttcaaaagctcctcaagctcagccggaacaacgcgaccacggaaaacaaacgccaacgcattatcaaggccgcgttgcatagaactgtccagcttggccaaactgttcatagcattagctatccgattcgaagtagccataactttgcgacctccttttctcaataagttgggtgttccataagtgtcttctcctagaaaacgcctaagggcatggctttgtccctccctgtgactgaaattccatttagaaaaaccttcacacggtctaaaccaaagcgcacgatagcgtcattatagaggtgaacggcgccagagttataggccaaaccaccgggatgcataaatttacaactttgttgccattcaggaaaccgctatttagctgccgatttggtattcaacgccaagtgcgtgctatctttaacaagtcgcaaaagacaccctgcccgggtggcggaattggcagacgcgctggcttcaggtgccagtgttcgcaaggacgtgggggttcaagtccccccccgggcaccaagagcggttctcgaactgcacaggccggagatcacaaactcgaaagagactgtgatctccggttttgtttgtctttgagtatgactgtgaaatgtgatggatttattcgaaaggggaggagtcttcttggaggtaggggcgccctgattggaaccgccagatggtgtggtcgaggtagatgtagttgacgcacataatgtccgcaacttcctcaatcaaccgtgaagcttcgtgcctggaaatctctttcggacgctcgagcacgtgagtgacgaaacggacgatcattcggtctgctttcactcctgggacacctacgagcataaggaagtaactccaggtcaacgcactactttggccggttatcatcaaccattctctcgcgatatctgagtgttcacggctttcgcgcgaatcgaacctgccgacaacatcgctgatggattcgatggaatgacccgcaagtacctttgctgcttccaaagctgcgtatgccttatagggtgcgtgaatcttggaggaagttctccaccgattattcgttttgagaacaaattcgtcgacccctccccaccggtagaatgtctcgatgagatcagtggcagtatcggcttcagggtgtgatccttcatttgcgcgcagcccgcagtatcgattgacaaggttgagtacacctgtatagcgattaccagtcgagtaaatggagtcaagaatcgctagggcaatgctttggtagccttcaggatgaaaccatctttcagggtcaacaccaaagtgtgaagtgatgtagtttaacagcttctgaacgtcttgctcatgaatcaacggagttcctatctgtgctagtggagctagatagataggatgtactttcgtccctgattgacgacggaaaatctgcaggatttgaggggcggtaagacctgagaaagatgctcaattacccctctgaatgaagtttatttctggctaagttgcgtgtcttgttttgcgctgatggcttcgtttacactttgatcgctttcgcttctaagagtggcgagtgcagcagaaaggcaaacctgctcttcaaatccaaagacccaaatgaagtatggagaaaaataatctttcttggaaaagtgatatcccctagtaggtagcctcaaggggtattcaaatttgaagctggctacatccacttttcaatttccgggtttaaccacatcggaatctccgcggcgtagtccaataattcctctaaatctgccggagcttttagaccatcgaatgcatttctccaatgtatcttttgcggagccttgagatcgatcttccaaataaacccatcacctgccatccagtcggcatacattagctctactgccccaaattcgatattgtcaggaatgtattgggggtaaatcttgcaaaagtagcccacgaaagtcgcaccatccattggcgcaactcttcttggatcagccctaaatacaactatgagacagtcgtcctgtacccatgttgcagccatggtcagagtcggccacgttgattttttgtatgggtcgtaggcgttttctgacgggatgagatcttcaaacagctgtgacatgcggaagactactttttcaaagtcaagatcatagtctgctttgtaagtcatgattactgatcttatctcagcacacagttgcgtttgggaaatacggcgatgtcaggttttctcactgaagtcggtgttaagaagtcgaacttaacgcagacctactccacaactgcagctcccaaaacacaaaaaatccaccacaaacatcccagtgtttgcggtggatttgtaaaggggcagatgctagccggcgtaaggatcccggataccgatgtactgcacggaggtgtactcctcgattccttcgagaccaccttcgcggcccattccggattgttttacgccaccaaaaggtgcagcagcgttagagatgacaccggaattgacgcccactaggccgaactcgagaccatcggagacgcggaaaatacgtgaggtgtcctgggtgaacacataggaggccagtccgtattcggtggagttggctagacgcagggcttcttcctcggtttggaaggtgacgatcggtgcgacgggaccgaagatctcttcgttcaggatagccgcatctgttgaaactcccgtgagcaccgttggttcgtagaagtagcctgcacctgtgccggccttgccgccggtgaggacggtggcaccttcggcgacggcggcgtcgacaagcgatgcaacgctgtctcgtgctttttcctcaaccagggggcccacggtgacgccttcgtcgaggccgttgcctaggacttgctcttcaaggcgggcagcgaagcgacggccgaattcatcggcgacggattcgtggactaagaaacggttggctgcggtgcaagcttcgccgatgttgcgcattttggcacccatggcaccttcgatcgcgagatctaggtcggcgtcctcgaagacaatgaaaggtgcgttgccaccaagttccatggaggtgcgcagaactttatcggcagcctttttgagcagctgctggccaactggggtggagccggtgaaggagactttacgaaggcgatcgtcttccataatcgggttggaaatcgcagaggcggaagcaccggagaccacattgaggacacctgctggaagaccggcatcaagcatggtctgagcaaaatactgggaggtcagcggggtaagtcgagctggcttgagcaccatgacacaacctgcagcgatcgcaggtgcgaccttgcgggtagccattgctagtgggaagttccatggggtgatcaggaggcacgggccaactggcttgagggcggtcagcatccgcaagttgccttctggtgtggttccgtaacggccatacagacgaactgcttcctcagagaaccagcgcaggaattcgttgccgtaggtgacttcgccgcgagcttcagccaaaggcttgcccatttccaaggtcatgagggtggcgaactcttctgcacgttctgctacgagctcaaaaccgcggcgtaaaatattagaacgctcgcgcgctggcatcctagcccactcggcctgaacagcgcatgcagcatcaagagcagccagtgcatcctcggaagtagcagacgcgagcgttgcgattgtttcacccgtcgctgggttttccacatcgaaagtaccgccgtcggatgcttccacccaggaatcaccaatcagtagacccgtggggactttggcaagtagttcggagacattaatagtcatgatgcgttattttccttcacttttcgtatccagcagcgttgagttgctggacatcggcaccgactcggacaaagttggcgccggcgtcgaggtagtcctgtgcttagttcaaatcaaaggcattgacacccacaggtttaccagcatcacggaaagtttggatggatttttactccggccacaacgtctggctggaagctcagccacgtgctttctggtcgtgcgccacgacgagcactacccagctgcggcaaacctcattgctttcgataagggatggtccaccctcatcgcccctcagctggaagatccagaggcggaggagttcaccgccggattcctcaccgaataccaggacaatctgatcactgcgggcatggagcaccaggcgctcgcgagcggcttcccggtggggcgtcgcttcaagtccgatattgctttacgacgctgcgatgcggtgaccacccacatcggccacgaacactccgccgatggtcactggaggatctacgtattcgctggccaagccaccccacaagattccgagtctgcactgaacaagtgggcgcagtggatggaggaaagcgaagactcaccactcaaccgcttcaccccagaagccggcgaccgcaacgcagtcttcgatatcaaggctacctaccagcagcattaccactccttcgacctgttcgatgcgccagaggtcttcttcccacgagttggaccatacaagctgcaaaacctcgaaaacgtttggaccgcactggattcccaagacatctttgagtcccgtggcatcagtcgcgatggcgcaattgttgtcgttcgcccagaccagtacgtcgcagcagtcctcccactcgaagacaccgcagcactggctgagttcttcaatggcaatctgcttgagccataaaccctaaattctaggaacgattccccggaaccttgagtggtttcggggttttgtgctttttcgacagaatgagtgaacctgcgcttgaactataccccctggggtattactgtagattctcaataccccgaggggtatctagtttttacgttgagaaggagagctcagtgcttattgaacgcatctacgacgaagaccttgcgcaggccagctatttcattggctgccaagcccacaacaccgcagtcgtggttgatccgcgtcgcgatattgccgtctatctggacatggccaagaaaaacggaatggagattgttggagttaccgaaacccatatccatgcggactatttgtcaggaacccgtgagttagctgctgcaactaatgccaccatgtacgtctcaggggagggcggcgccgattggcagtatgaattcgacgccgagcgaatatgcgacggcagcgagattcgcctgggaaatctggtgctcacagctgttcacaccccaggccataccccggaacacttatcgttcctgctgaaggacggcgcgttcgcagatgagccaggattcatgctcactggcgatttcgttttcgcgggtgatcttggccgaccagatttgctcgatgaagcagctgggggagtggacactcgttttgagggggctcgccaaatgttcaagagcttgaaggaaaaattcctgacattgcctgatcacatccagatcttccctggtcatggttccggttccgcgtgtggcaaagccttgggttcggttccttcaacaacacttggatatgaacgtcaatttgcgtggtggggaaagtatctggaggcagatgatgaacaaggattcattgatgagcttctggaaggccaacctgatgcacctgcatacttcggcaggatgaagaggcaaaataggcaagggcccgcaattatgggcgctcgcgagctgttgccacagctggaagcttctgatctgcacgacgtcattgttgttgatacccgctcagccgatgaagttcaccagggcactgtagctggtgcagtgaatattcctgcgggcaattcgatggcgaaatttggctcgtggaccgttgatcccgagaaggattcccgagctttggttctgctcgcggcaagccaaattggtgccatggagatgtgggaccacatggttcgcgtgggaatcgataatgttgctggttttatcaccaactttgatggggtggacctagttgcaccgcaaactgtgtccccagatcagctggatgaattggaatacgatctacttcttgatgtccgcaaccgcagtgaagtcgaagaaggctacatcccaggagcactccatattaatggtgcatccgtgctgtggaatctggagaaactgccacgtgacggaaagatcgtgagctactgcaagagtggaacacgcagctcaatcgccgcaagcaccctgcgtaatgctggttttgatgtggtggaacttcaaggatcctatgacaactgggtccggcacaacgcacaataaacaatagtaaaaggaaccctcacggattgtgagggttcctttttttgggtttcgccggagggagacgtcgaaaagcttataaaagctccaagccgagcacgaacacgcccatgaccagcacgaacaccccgaaccctttgcggagcaaagtctcaggcacgcgccccgcaaggcgcgaaccggcaagcgaaccgacgatggcggccgcagtcaccatcagcaccagcccccaatccagctgcacgctggtcagatacccggcaagccccgcaaacgacttcatcgtgatcaccaccaacgacgtgcccacagccaccggcatcgacagcccgccgagcagcgccagcgccggcaccaccaaaaagccgccgcccgcaccaacaagcccggtcaccgcgccgaccaccaggccatcaacaaggacgcgccaaagagagcttttcgacgcccccttcttctgcttacgcccccgcaacatcgcagtcgacgtggcgatcatcatgagcgcaaacgcgatcatcaaaatcgtgccaggaatgtagcccccgagaacgccaccgccaaacgcgccaaccatgcccgcggcaccaaacagcaggccagtcttccaccggacccgcccatttcttgcgtgactaatggcactgaccagcgacgttgtgcccacaataaacagcgaggcggcaatagcttcacgaggctccaaccccgccacatacgtcagaattggaacagtgaggatcgaaccaccaccgcccaacagtcctagcgaaatgccaataaaaagagatagaaaaagagtgaggagcaaaacggcggtcattggggacttcctacttaatcggcagattgttttggtaccacgcactcattccgccagtcatagagtacgcggtatatcccgcctgtttaagtgcatttgccacctgtgtactgcggttaccgctgcggcacaccacaatgaccggccgattctgatctagctctttgaagcgaaagttgagctcacccatgggaatatgtactgcctcggggattatgccctcggcaatttcaaaattttcgcgcacatccaggatctgatccaaatttcggcgcttgttagtttcagtaatggtgatagacatttagttctccttagggcttggaagcttgctcaatgtctcggtttcggtaggaactggcttagttttattccacggcaaggcggacagagctttgcccatggcacaggtgttggaaacgccagaaaatgtcagacccgcaccaataattcccgacagggtgcgaacttttggtgaaaggaatttacctcccgcaagccctgcgagcaccaatgatccagcggcaaaacgcacctgacgttcgatatcccacacctgggttccgcggaccacatcaccgtcagccttagcaaaactattgatgccaccctccaaaacagccacggtggaaattcccaaaggtgccagcttttgttgtgcctgacctgctcgaatgccggattgacacaccaaaacaacatgttctccaacacgagaggaaatctcttcggaatgctcagcaagtgtagttagaggcacgttgtaagagcctttaatgtgcaaatttgaaaactcatgtgcagtgcggacgtcaatgacggtgagtccttcatgcttatcgatccacgattttagagtctgtgcatctacggaagtaatcggttgagcggaagtcataccttgtccttttcaatctcaaagtgatgggcgattccaagtgtgccatataccctggggggtattcaagataggggtgggggtatactgtgggatcaacgttccagggcaacaaaaggagaaaaaatgcaactcaatcctgatgagatcaccccagtgctcaaccgactcaagcgcgcccaaggtcaactcaccggagtaatccgaatgcttgatgaaggcgaagactgtaaagccgtagtcacccaacttgccgcagtcacaaaagcgctggacagggcaggcttcgccatcattgccacaggtttggaacagtgcctcaccaaccctgatggcgacatggacaaaaaggaactagaaaaactgttcctgtcgctggcttaactatggcctagttcagggcgtttgggtgtttcgggcgtcaaggggcgacttcacgtgtgctgacttctcatgctcaacttcttatcctcggcttcgctgggaaagcccgggtttacctaacgaagtcggcgacgtgaagtcgtccttttgattaggtgtttaagttcgagacctttagttcgatttcacggtaccgatttcgcaagttcgataccttggcgctcaatttcttaagagcgatttcggtcggtttttggcgtttttcctagtggtctcgaaggtaagaaattgaggatgcgaaactgtaaatgcgaaatcgctgttgagaaatcgaactttaggtaaccggcgggagctgaaccttttcaaaacctctcaaaaccgggagcccccgctctaacccccactaggtgcactgatacctttgcactaatgagaactgtttttcaattggtgcaggatttccacaaggaagctaggggagaggggcttccaatcaagtggggtccatcgcgtggagaatttggcatgctggagtttcctgcagatgtcattcccgagaacatcaaacacattgcgcagacaaagttccagactgaagcaacttcggtggaggatattcgtcgtgcgattaacctgctgagtgatcaggcggagcgtgcgggtgcgtcctttaatcctggtttcattcttgcgcaggtgggctccaccatcgtggaggtttatggcggtgctccggttgcttggctggatgcggttgagctgttgattagtcctgatgtggagtgggttggggttcatggctcaaggaagctcgatattaatgtcagcggagaattgtccggggtgatttctgctggtgacaagttgggtgaactgcttggcgatgattggacaatcaacattgttcacggcgagtacaaaatccagatcgaagatgctcgaccaagtactgcattccttgcggacgcgactgaactgattaatcaggcaaactctgagattgttccgttccatgttcggatgctcagcaactcgaaaattgtgatgtctggctttagtgattattcactagcgggtgatgcgattacatctgcgggaaaactggctgaattggcgaggccttttgcccactggaaagaaaacgtcattcctacgatagaaatagccatggactatgaaccatcaccggtggcagatctttggcagggagattcttcggagacacctgagcctttcgacgattttgagcgcttattgcgggaagaaatgcttattcctgagatttagctggtcatagacctgctgttttcctataagggtagatggcaggtaaacaaactcttaatttaatgagacgtaagtagttgatagttaggggaaatactcccaaatcctcacaggaaacgctctgaattctttcaaaaaaatgtttcatgcttattggcatgagcaatcaaacagtcaatcaagcagtgtcgtcaggggtgaaagcatccccgcacaggttcaatcgttttgaaatcaaatacttgattacagagcaagatgtacctgcactccgcgagcagttggcaacgaggatgagcacggatccgctttccccacccggaggctaccgagtggaatccctttacttcgattcagccgatttacggtgctacaccgaaaagatcgagggtctgaaattccgaaggaaactacggatccgtacctacggtgatggagtgctcactccagaatccaccgtgtcggtagagatcaagcagcgggttaacaaagtaactcaaaagcgtcggctggatttgccctttatatatgcgctcgccctgggcgatagcacgggcgccgcggtaggcgagcaggtggacgtcgagaagcttcttgaaatctctccggaaaaccagcacgctttgattcacgaaatggcgtcgtttgctaaaaattatcggctgcgacccatcgccaccacgaagtatcaccgcgaggcattcgtcggcgctgatgcggaggaaagttcgcgagtcaccattgaccacggtgtttcaggccgtgatcgtgattttctgcttggccaagaccttgaagaccgcccaacggtggcgcaaggattggcagtcgtggaaatcaaatgcgatgaacgcgtgccgttttggctcactgatatgactgctcaactggaaatgtccgtgattcggatgtccaaatactgcgaaaccatcgaagcgtttcacaaccgtccggcatcagctttcggcgctgtcgaccccatcttctaaacaagaaaggcccctccaatgttgagcgatctgagctccatttttgacttccaagacctctccggcaccttctctgtcgtcgacgttctcatcactttggtcttgtccttcgtcctgacctccatcgtgggtgtggtgtaccaaaagacccaccgccacatctcctacagccagtcattcgtacaaacgttggtgctggtgggaatggtcattgcaatcatcatgctggtggtcggctccaacattgcacgtgcattcgccctggttggcgcgctttcggtgattcgattccgcaacgcagtgaaagaaacccgagatgtgggcttccttttccttgccatggcaatcggcatgacttgcggtacccgcttctacgttctggcgatcgctgcaaccatcgttgtctgtggcgttctgttcatcatgtaccgcttcgactggttcaaggctgatatccagcgccaggtcatcaaggtgcaggtcccagccgatggacaagctgattccggcaggtcctacgcagaagaagttgaactgatcctcgcacagtactgcacttcctttgagatgatgtccgctgaatctgtccgcggcggagccctgaccgagttctcctacaccgctcaaatgcgcaagaacgtgaagccacatgagctggtcgccaagatgcgcgatgtgaactacggccaaaaagcgactgtcctgaccggtcacgatcaaacggatgtatagaaaatgcctagctttaaatctgctcgatggaggatgaacagacgcctcttcctaggaacttccgcagctatcatcgctgtcggtggcgtgctcggtggagtgcaggttgtaccttatatttcctctggtgaaatccaaacgtcagcatcatcgactgccacgatcgatgtcggtgcaggcaatgtcgatatttttgatacctccgtttcccatgaaatcagcctgcaggtttcgcaggaaagcctcgatgagatgctcgcggactatcaagaagacggttccaaaacctgggtgaaagcaaccatcacgattgatggcgtgaccattgaaaacgtcggcatccgcctcaagggcaactccacgctgtccgggttgggtcgaacatctgaagaaggcggacctcaggcaccagaaggcgtcgaagagtttacagatctcagtgaagaggaaatcgcccagtttgaggaacagttcgcggcgcagcaagagactactgacgcttcagagaccggtgaaactgcggaaaatgaagagactcgcggccccggcggtggcatgggtggtggcggcatgggtggcatgacttcggtcgatgccgacgatgtcagcacctggccacttctgatcagcttcgacaaatacgaagacggccgcgtctaccaaggcatgacccaactggcactacgccccggcaccaccgtggtcaacgaagcaatggcgctggccctgaccgcagaaaccggccaggtctcgcagcaatccagcttcacaacgttttcgcttaacgacgagccctccaccactcgactccttttgaagcaccccgatgaaaattatgccgacgcgctcggcaacggagtcctcttcaaagcagattccaacagttccttcacctaccaaggcgaagaccaaactgaatacgacggacagttcaagcagatcaacggtgacggcaacggagacatccaaccgatcatcaacctgctgaaatggctcgacaccgcaagcgatgaagagtttgctgaacacctctctgactacgtcgatgtggaaagctttgctcgctacgttgccactcaaaacctgttggtaaattccgacgacatggctggtcccggtagtaattactacctgtggtacgactacgacaccggcctgatcagcgtgatctcttgggatttgaacctcgcaatgtccggctcaactgatgctggcccagatgatgaaatctccatgggcggaggtggcggtggcggaatgcgtcctggtggaacgaccgacactgaaattgaaggtactgcgaccgaggatatgcctgacatgggcaatatgcagcaacgtgaacgccctgaaggaatgccagacatgggtgagatgcctgatatgggtgaccgggaaggcggtggatcgatgggaggaaaccagctcaaggaacgtttcctcgcttccgatgcattcacggaaatctatgagcaggtgtactgggagctgtatgaagaaatgtatggttccggaactgccatcgagttgttggatgagattgcagcgtcaattccagaaactgatgcggtgactgcagatgagatcgctacggaagtggcgtcaatgcgggaatggatcactgcccgcacagaagcgttggctgctttgcaagagtgatcaaactagaaaaccaacaagccctggaatttccgaggcctgttggtttttcggtttttgtctcacatccacttactgcgtttgaagatccagtacaaaaggagggtgaatccgagcattgctaagagagccaacgggtagccaaacgcccagtgaagttctggcatgatgtcgaagttcatgccgtagatggaggacacgagggttggggcgaagatgatggcggcccatccggagattttcttcatgtcttcgttttggcgttgggctacaagggtggcgttgacgttcaaaatttgggatagggattcgcggtattcggagacgcgggtgttgtcgcgggtgaggtggtcggcgacgtcgtcgaggtaggcgcggagttcttcggacatgccacttcggatgaagtctttgttgaggcgttgcaccacttcggtaactgagctggtggtgtgctgcatgtcgatgatttcttgggacaggttgtaaatacgttcggcgacggcggcgtcgccggagaacacctggcgctcaatctgttcctggtcgatggcgatgcctctaagaacgggggagaagccgtcgacgatggcgtcgacaagcctataggccacggcgcgggggccggacgagagtaactcggcgtcggcaagcaatgtttttatgcgcttatcgatctcctcggggttgctgaagctggcggcgctggtgccgtcaatccattggttatcctggcacaaaatggctatggcctgaggcttcatgaggatgtggaattcggagaagtccacctcttcgcgggagtcgatgtagcgcgcggagcggatcgcgataaaaatgatgtcttcgtagcggtctagttttgggcgctgctgaccaaggagcaagtcttctacgatggtggggtggaggtcccaggcctctgccaattcctcgattgcgggcttggatggcgcagggtacagcgacatgaccatgcggttggaggcgccttcggcgaattttaaaccgtcagcaacagtggcacccagcggtgggcgcttcgggatgccgtcggtgacatagcgggtcagcggagaaacctcttcaggtacaggagttgaatttgccgaatcaggaaggtaccgacgtctgagcatatcccgtctgcggatcgccccgttgatgtcgtaattctttggcattttcaactccttcaacagttctggacagcaatttctactaagtcagtattgccgatgaagtaagaaatggcctattcgagagctattctgacgatccttctagctcggtcaacctttcccgcaggccttcgggaagcgaattaaaccacttctcctcttcgccaggttccatgaggagacggccatattccgtcatattggaaccaggaatctccgttatatatacccatacttcttcattggggatcccaagaatcagcgcgatctcttgtgtcagccgaagcagaagttcctctttttgcttctctgtacgccccgaacgaatcgttgcttggacccaaatgtggttttccgacgccgactgcgccgcaatgaaataagaatcaggctccacctcattgaaaatcacctgcaccaaatacttgggagcatgcgctaattcatggtgggcatcggtgattgcctcagcgatgcgttgcttggcttccctagaaatgcgaattctttgcgaccaacaagtataagtaggcatgtgcgtgaacctctttcattttggaaaacctggaaaattgagaagctatccctcatcatagttttaaatctggggcagaggcgggaatttaaacacctctgatacagcgtttactggctatagtgttgcgcgtgccaaatcgagttcctgtgtcaaccattccgctgaatcgtctagccgttatcgctgccatcattggtgtcggtaccgggctgtttgttgctgcactgaactggtctgccattggcgtggagcgtttagtttatggcgctgaccatttgcataattacaatccggtggccaatgtgtcgccacttcgcctgtccatcacggtgattgtgcttagcgtggtggcctcctgggcgtggttttttgtgcaccgcacggggccgaaagaggtttcgattgtgggtgcgatccggggcgagaagatgccgattttggagaccatagcgtccgcatttttgcaggtcaccacggttgctgcgggtgcgccggtgggtgcagagaacgctccacgtattgctggagccttggtgggagagcggtttagtcggtggttgcagctcgatattgatgcaaagcgcatcttggtggcctctgccgcgggagctggtttgggagcaagcttccaccttcccctagcaggcgtgctgtttgcccttgaggtcctactggttgaggcctccactcggaccgtggttatcgcaattatcaccacgaccgccgccgttgccaccactggatttttcgtgcaaaccccagatgtgttcagcactgtcccgctgacggaaagcccatggatgctgcttgccgcgatggtcaccggagtagtcgccggcatgtgcgggcactggttttcagcggcggcgcacaaaatggcgcaggcctcgcccaagggtgtgaagattttgtggcagatgccgttgggtttcgtggtgatcgctgcggtgatttatttcttccccgaaaccctggcgaatccccgttggcttgccgattccatgctcggcgatggcctgatcctcagcaccattttattggtacttgttctgcgcaccgccatgtttttgctcgccttccgcgtgggcatggtcggcggtaacctgatccccgcattcgcactcggatccatggtcggtggggtagtgggtgctgtattggaacccatcactaacgtcccgatcgccgcttttgcgctgcttggcgccgccgcatttttgtccaccaccatggcagcgccactgttcgggctcatcgccgcagtggaattcaccgacatggaagcccaaggctaccttccgattttcctcgcagtagcctccgcggtcctcgccgtgcgcgtgtggtctgtcatcgccaagcacgagctccgcgccatcccgatcacgtacgcgagctggacgggcgagcttaaataagcttgtcgacgcctccctccaccttctatttagtaaacgcttttcagactgtcacagactcctgagcttccagcgcacgagccttgtctgctttttgcacccgcagccacacgacaaatccccagctgacaaacgcaccgtacaccaggtaaagcaccgcggatgggtagtagccagcagtcaaaagtagaggaacgccaactatgtcgacggcgatccagatcagccagaactctgtccatccgcgagccattccgtaggtagccaggattgagccgacgaaaatccacgcgtcggcccatggcccccaggagccgagtgcttggaaaatccaggcaaagctgagtgttcccacaaccgccgcaatcacaatgccggcgcgttctttggtgcttgcccagcgaggaaccactgctactgcattttctggggtgagtgcgcgacgttttgcggccgaccattggtaccagccataaccactgacgatgatgaacatgatctggcgacccgcttggccgtagagatcgaggttttgtggagtgtggaaaaggccgcccataaatactgtgaacagcagcgcgttgcctatgatgccgatgggccatgcccacacgatgcgtcgcattcctgcccacgcgctaaataatccgaaaacgttgccgatgatttcgcgccacagaatcggaactccgccgatccatagtgttgcgtctaataattcggttataggattcatgatcttgtccccttttcaaaggatttaaaagcatgtaatcctcggggccttaattccgggttcgccaaaaatcagcgaaaccacggttctcttgcatccggactatgaccgtcggctccggaatttaaccggatctgctgacccacaaaccattgctagttggtggcgctcgcgggctcaactagtcatatctgatgattcgtcttaccgccggtggggaatttcgccccgccctgagaacaaaactcactatagcgcttgacgcggaaagtgtgaagcatatgaaccgtcctggttgaaactgaacgattggtgaccggctcatgaaaacttgacgagtccccggtattcgccagcggtgactactaccgtgggcgacaagcccacttagaggaggacttgtgacaaccacctatccagatttccttggaaattcttcgctccaaacagatacggagcactgggaaatggaaggaggtgcgcaggaagtctctgttacttatgttttggacacgtcagtgttgctgtctgatccgttgtcgttgacacggttcgcggagcacgatgtagttctgccaattgttgtaattacggaattagaagccaagcgtcatcacccggaccttggcttttttgctcgccaagcgcttcggatgctggatgagctgcgtgagatccatggggatttgtccaagccactgccaattggcgatgaaggcggacacatccatgttgagctgaatcaccaaaacacggggtccttgcccgtgggattccgccttggtgacaatgacacccgcatccttgcagtggccaagaatctgcaggaagagggccacaatgtggttctggtgtcgaaggacctgccgatgcggattaaggcgtcggcaagcggaatcgccgcacaggaataccgcgctgccctggcgcgcgaccgtggttacaccggcatgacccacgccaatatcaccgatgaccagctcagcgagctctacgacaccggcgaggtgcgcattgaggagctcgaaaagctgcccgtcaaccacggcttcaccctcaaatccaacagcggttcggcgcttggtcgtatgaattccgacaagatcatcgagcttgtccccggcgaccagcaggtattcggtatcagcgggcgtagcgctgagcagcgggttgccattgatttgcttaacgacgacgccgtcggcatcgtatccatcggcggccccgcgggtacaggtaaaagcgcactcgcactgtgtgccggcctggaagctgtgatggagcgtcgcattcagcgcaagattatcgtgttccgcccactctttgccgttggcggacaggaacttggctacctgcctggcgaccaagaagaaaaaatggggccttgggcgcaagcggtttttgacaccctaagctccatggtcagccaaaacatcatcgatgaagccctctcccgcggcctcatcgaagttctcccacttactcacatccgcggacgctcactccacgatgctttcgtcatcgtcgacgaggcccaatccctagaacgcaacgtgttgctcaccatgctgtctcgcatcggccagaattcccgagtagttctcacccatgacgtagcgcagcgcgacaacctgcgcgttggtcgctacgacggcatcgtctctgtggtggaagcactcaaggatcacgaactgtttggccacatcacgttgcagcgttccgaacgctcccgaatcgctgagttggtcacccaagttttggatgcgccgtctctgtagtcgcgcagtctgtggcgatttaagggcttggggtcgctcaatgacctgttgccctggtttgggaaagttagggcttcaggagcgattctaggaggggtcgattttggggccattggggctgttgtgaatcctggcagtttgcagggcaaggatctaccacgtttgagcggaaacctcggatctgtggtggattcgtgcaagattggcctctgaacttgcaaaaatccaccacgttttggctgatcagagcgatttgtggtgaatcctcaccattactgctgtcgaaggtgggaaaggttgaggagcgccaagactatcgagctcactagggcagcgcccgcatatgaaccaatagcgatgaagataagcccgactccccaaaggcctgtctcatcaaagggggccgagatggcggcgaatgcagcgccgatggcaagtgtgaggccagccgaaactctagtgattacccgcttcgcagttaatcgctgcctatagccccaaaaggtgagtgcggcacaaattaggacgaagttggtgcaagctccgataacttgcatctgggagaactcatttgctccagtgaaaacaagccacaccgcagcgaaaatgatgccaacaatgaaactgcggaatcctaggccgtactcacgattgctcatagtgggtgatcatattagaaaacccctcttccccgtgcacagaacaacacggggaggaggggtttggcgtcgaaaagctattttatgcgctgagtggcacgacgccgatgaagagggctacggcgagcatcgcgatggacacgatgcaggcgcgccacagaaccttcttgtggtggtcgccaaggttgacgttggcgagggaaaccagcaggaggatcgctgggaccagcgggctttgcatgtgaacgggctggccagtgatggatgcgcgggccatttccacaggctcgatgccgaagtgggaagcactttctgcaaggactgggaggatgccgaagtaaaaggcgtcgttggacatgaagaacgtcattgggatggacagcaggccggtgataactgccaggtgagggcccattgcgttcggaatgacggtggtgatccaggtagccatcgcgtcgaccatgccggtgccgctgaggacgccgactaggacgcctgcggcgagaaccatggagacaacgccgacgatgctggaagagtgcgccagcatttcggttgcttggtccttgaccttagggaagttcactgcaagtgccagtccggcgccagccatgaagacgaaggccagtgggaagatatcggcaaccaggagaaccatgacgaccagggtcaggactgcgttgaaccagaacagcttcggtcgaagtgttgcgcggtgtggatcgagcagagtgtcggtcatgttctcggtgagggtggagtcgtcgaggttgatgtgctgctcggtttcaacttcgcggtcctcaacaagtacgccaccagtaggtcctggctttggagcgtcctttgccttgcccagtccgccgaggcctgggaagcccttcttgttggagctggagcctgagcccgttcctgtttctggggcgtcgagtcctggcccaccgaagcgggaggagtcaatcttgcccaggcgcttgcgctcggagagaccgaggaaccatgcgaacagcaggcagatgacaacgccggcgatgagggaaggaaccattggtacgaaaacatctgctggctcgaggccaagtgctgcggctgcgcggacggttgggccaccccaaggaaggatattcatggtgccgttgatcaggccggcagtacaggtgagaaccacagggctcatgccaaggcgcaggtagatgggcagcatcgcggaggtggtgatgatgaaggtggtggagccgtcgccgtcgagggagacaacacctgcaagtactgcggtgccgatgacgacctttgcggggtcatcgtgaagaacgcgggtgatcacgcggatcagggggtcgaagagtccgacgtcgatcatgattccgaagaacataatcgcgaacatcaggagtgccgcggtaggcgccatgtccttgatggcgtcaagcgccatgtcaccaaggccgagtcctgcgccggcgatgagaccgaagatggtggggaccaacagcatggccaccattggggtgagtcgacccagcatgatcagggtcatgaaggtgaggatcatggcgaagccaaggactaccaggatgccatctgagggggtgtggctgagcgtgtagtcagcggctaatgccgtgacttgtcctgaagccaggagaagtgttgagctgctcattgctgccctttctgtgtttctcgaaactttgagatcccgagtgttctgtgttgcttgtgggagtataaggtggcgcgtgtcacgcacagaagtgtttggtgcattgcctgaggtagtgcgcaaaataagacttttgtgcattatgatcagaattgttggcctgggacttcgcttcacgctctgctgataatcgcccccgggggtagacatgtctgttggtggatccgactggaaaaacttcaaggaggtggacatcattcgctttgctacccgaatactggtgattcaagtggctaccgtcgcgttggtggtagctatttgcaccggaattttcgcagttttgatgatggatcagatgaaaactgaggccgagcacacagcgctgtccatcggacgttcggtggcatccaacccgcagatccgcgaggaagtagcgcttgatactcaaacaggagcaaacccatcggccgaagaattagccgatggagatatccaagcggttgcacaggcggccaatgaacgcactggagctttgtttgtcgttatcactgacggtttaggtatccgcctgtcccacccagatgaggaacgtctgggggagcaggtgagcactagctttgaggctgccatgcggggtgaagaaaccatggcgtgggagactgggaccctcggtgcgtccgcgcgagcaaaagtgcctatctttgcgccggattctagtgttccagtcggtgaggtcagtgttgggtttgagcgagacagtgtgtattcccgcctgcccatgttcctcgccgcccttgctcttatttctgtgttgggaatccttatcggcgtgggtgtagccatgggcatgcgacgccgttgggaacgcgtgaccttgggtttgcagccggaggagctagtgacccttgtgcaaaatcagactgcagtcatcgatggcattgatgagggcgtgctggcgctgagcccaaacggaacaattggggtgcataatgagcaggcgcaatccatgattggtgcaggtcctatgagtggcaggacgttgaaagaactagggcttgacctgggtcttgatggcgttgtattgcatggtcagcatccggaaaccgttgcccataacggcaggatcctctatctggatttccaccccgtgcgccgtggggatcaagatttaggctacgtggtaaccatccgcgatcgtaccgacatcattgaactcagtgaacgcctcgactctgtgcgcaccatgacccacgcactccgcgcccagcgccacgagtttgccaaccgcatccacaccgcaacagggcttatcgacgccggccgcgtccacgacgcggcagagtttctaggcgatatatcccgcaacgggggacagtcacatccattgatcggatcagcgcacctcaatgaagcatttttgagctcatttttaagtactgcttctatttcggcatctgaaaagggcgttagtctgcgcatcaactctgacacgctcatccttggcactgttaaagatccagaagatgtagcaaccattttgggtaatttaatcaacaatgccatcgacgccgcggtggcaggtgaagccccacggtggattgagcttacgttgatggatgatgccgatacgctggtcatttctgttgcagattctggtcctggaatcccagagggcgtggatgtatttgccacagccacccagataggagactctgaagataatgaacgcacccacgggcatggcattggtctaaaactgtgccgggctttggctagatcacatggtggcgatgtctgggtgattgatagaggaaccgaagatggcgctgtatttggagtgaaactaccgggagtaatggagtaatggatcaaacacttaaagttttagtaattgatgatgatttccgcgtcgccggcattcacgcctccatcgttgatgcgtcccctggattttcggtggtcggtaccgcgcgtaccctcgcagaggcaaaaaccctgatcgccacattttccccggatctcctacttgttgatgtctacctccccgacggcgatggcattgacctcgtgggcacctccaatattgatgcgtttgtgctcagcgcagccgatgacatcaaaacagttcgacgcgccatgcgtgccggggcactcggatatctgctcaaaccatttccccaaaaacgtctcgtggaacgccttgaccgttacgtccgctaccgccatgtcttatccggcacccaaggactttcccaagacaaaattgaccaggcaaccgcaatcctcaacggcacccaagcgccggtcaccgtctctagatccgccacagagcaattacttctcgacgccctggaaggccaagaactctccgcaacagaagcttccgaagctgccggagtttcacgtgccacagcacagcgcaggctggcagcgatggctagccaaggtgtgatccaggttcgccttcggtacggacagtccgggcgaccagaacatctatattcaaagccactgctctagtaacctttgtggatgtccacctcggtcagcatcttttctccagcgagaaaccgtcggtagttttctgccaccactggggcaagcatgcgatccatcgaggtcaacgtgttggctacgtgcggggtaatgatcacattgctgcgcccccacagtggatgatcgtccggcaatggttcaggatcggtgacatctaagcctgccccggatatttcttgggcatctaaggcgtcaactaatgcttctgtatctactacttctccgcgagccacgttgatcaaaattgcagtggactgcattgctttaagctctgcttttccgatcagatgataggtgtctgcggtaagcggtacgcacaacaccacatggtcggcgtcggcaagtacttggtgcaggttggatataggttccgttgcatcaaaatcttgggtgggtgtaccggtcctgcttactgctaaagactttgcgccaaaaggtttcaacatggctgccagatgtttaccgattccaccagctcccacaatggcaactgttgcaccatcaagccatctggtctgctgatctatttgagtgcttggtgcccaactatcggcacgcaccatggtggggtgcatatgaatcagtcccagcaaaagagccattgctgcttcggctacctgttggccatacacccctgatgcatttgaccaccggcgtttgtcatcaatctgcccagctgtgaaatatgcgttgagccccgcattgggaaattgcacccacctcactccgtcgggaagtaggggaaattctgtgcctggtgtttgagtgaagacaaacccctcggctttttcgagggagtccactatttctgcgcctgcctccttaagggccttggtggtgagtggataatcgccaaaaccaacaaagattttcatgggctccaggataggttgttggtgtgaggttgggttttgtcatcctgaatgcttcatttctaccctcgtgggtaaagttggtgccgaatcaacaatctcttttggaggaactttaatgagcatttccaacgcaatcctgcgtggtgtgtctggcgcttatattctgcagtccggctacggaaaacttggattgcctaatgaggccgctgctggcattcagggtctagctgcaacgggtatcccagcggtggctgatatggattcagatactttcggtaagtttgttgcctactcggagttgggtatcggtggagctttgcttgctccatttatccctagccgtcttgcaggtttgggtcttggtgctttctctacaggtttgttggccatttacttccgtaacccagcgatgactcaagacgacggaatccgcccttcccaggatggaaccggattgtctaaggatcttttccttgctgctattgcgggtgctttggtgttcgcacctgctaagaagcgtaagaaggcgaagaacaagtctaagtaagcttgcttgaacggcgcttgttagcaaggccgttcaaccgcgctgttaatcagccatttttgaacagtgttcaaaaattcttgaacactgttcaagtcatgggttaaggttgtcgtttaaggcacgtgtcattttgcatgcgcgtgcccaattcttcttaagtgtgctcaatttttaagcgcgcagttattgacaaccagcctctaggagatccatgaccatccccggcaccatccttgacaccgcccgcacccaagttctggaacagggaattggccttaatcagcagcagttgatggaggttctcaccttgcctgaagagcaaatcccagacttgatggaattagcccaccaggttcggttgaagtggtgtggggaagaaatcgaggtcgagggcattatttccctcaaaactggcggttgccctgaagattgtcatttctgctcacagtctgggttgtttgaatcgccggtgcgttcggtgtggctggatattccgaatctggttgaagccgctaaacagaccgcaaaaactggcgctaccgaattctgtatcgtcgccgcagtcaaggggcctgatgagaggctcatgacccagctggaggaagcagtcctcgcgattcactctgaagttgaaattgaagtcgcagcatcgatcggaacgttaaataaggaacaggtggatcgcctcgctgctgccggcgtgcaccgctacaaccataatttggaaactgcgcgttcctatttccctgaagttgtcaccactcatacatgggaagagcgccgcgaaactttgcgcctggtggcagaagctggaatggaagtctgttccggcggaatcttaggaatgggcgaaactttagagcagcgcgccgagtttgccgtgcagctggcggagcttgatccgcacgaagtccccatgaacttccttgatcctcgcccgggcaccccatttgccgatagggaattgatggacagccgtgacgctctgcgctctattggtgcgttccgccttgcgatgcctcacaccatgcttcgttttgctggcggtcgcgagctgactttgggcgacaagggttccgagcaagccctcctgggaggcatcaatgcgatgatcgtcggaaactacctgactacgctcggccgcccaatggaagatgacctcgacatgatggatcgtctccagctgcccatcaaagtccttaataaggtcatctaagaagcacgcgcatgaacgacgatctccaaatggccatgattctggcagacaccccgatctttcatccaaacaccggcaagcccttcgatggtgaacataagctgtcgccctctgcgcgagcaggtttggaagcaccccgttattgccagctctgcggtcggcgcatgaaagtccaagtccgccccgacgggtgggacgccttatgctcccgccacggtttcgtcgactcctcttatctagggcgccgataatgcgtggccatctcattgacggtgacggccgctgcatccactatcacggacccttcgacgtcgtcggcaacaaatgcgccacatgcaacgagtggtgggcgtgtcatcgctgccacgaggagattgccaatcatcctttcgggaagatgcttatcgacgccccgagctcccttcaatgcggccactgcggggagcttatggcctacggggtgcaaaaatgcccgcgatgcgggcataacttcaatccagggtgttcactccacactccgctgtactacgaaatgccctcttgacctgggaagttgcggactgttgtgcggatgtgtaaattaattccagtcagcgcgaccaacaacgccccaacacataagagattatgtggacagtgaggcggatctaggaaaacaaacgctcgacaaaccaacaacacttcatcgaagtcaacaaacaccgatttggtgaaagtaaacaagatgaagtaacgttgaacaagctgcttacgagacaccgagcaaggtgatcaagttagtgtgcgtatgttgtttgagaactcaatagtgtgccatttattatttttgtcactaccacagatcaccttgggtgatgtgtggtgggtcatgccgggtggtggatcgccaaattatccatcactgtaaacaataatcttattgttggcatgattttgtgggtctgcttgttccccgtcaagggactaggcccacgttgaagacacgatgatccttatttgggttgtggtgtttttttagaatcattattttttgataatgccagtaacaccccattatctgatcgcactgtgtgtggttggtgggggtgttgttgtttttgtcaggtgttgggcttttcacggcctaaacaatctatttattgtttttttgtggagagtttgatcctggctcaggacgaacgctggcggcgtgcttaacacatgcaagtcgaacgctgaaaccagagcttgctttggtggatgagtggcgaacgggtgagtaacacgtgggtgatctgccctacactttgggataagcctgggaaactgggtctaataccgaatattcacaccaccgtaggggtggtgtggaaagctttatgcggtgtgggatgagcctgcggcctatcagcttgttggtggggtaatggcctaccaaggcgtcgacgggtagccggcctgagagggtgtacggccacattgggactgagacacggcccagactcctacgggaggcagcagtggggaatattgcacaatgggcgcaagcctgatgcagcgacgccgcgtgggggatgaaggccttcgggttgtaaactcctttcgctagggacgaagccttatggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggtcttccacgacttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatggaccggatcggcgtagagatacgttttcccttgtggtcggttcacaggtggtgcatggttgtcgtcagctcgtgtcgtgagatgttgggttaagtcccgcaacgagcgcaacccttgtcttatgttgccagcacattgtggtgggtactcatgagagactgccggggttaactcggaggaaggtggggatgacgtcaaatcatcatgccccttatgtccagggcttcacacatgctacaatggtcggtacagcgagttgccacaccgtgaggtggagctaatctcttaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaccttttaggggggagctgtcgaaggtgggatcggcgattgggacgaagtcgtaacaaggtagccgtaccggaaggtgcggctggatcacctcctttctaaggagctttattaacccacatcagactgtgtctggttggtgggttgttggtgttggaacccgtatgtggttgccatcaacatattttaatcgggtggagatgacccctcgggtgacaacaacaagaccacatggtcttgaacaatgagtggcatgctgttgggtgtctggaatgacatcgcaagcatcaccttttggtggtgtgtgtgggttgtttctaacatcgagcatcgtcaacacgggtagagaatgttgtgttctttggttgtggtgggggtggtgtgttgtgtgagaactgtatagtggacgcgagcatctttatttttttgttttttgttgtgtgataccgaacgcgcccgcactttgtgtgtgggttatagtattttgtttgttgttttgtagggcacacggtggatgccttggcatatcaagccgatgaaggacgtgagaggctgcgttatgcctcggggagttgccaactaagcgttgatccgaggatgtccgaatggggaaacccagccgcagtgatgtgtggttacctgccagtgaatgtatagctggtgtggaggtttacacggggaagtgaaacatctcagtacccgtaggagaagaaaacaattgtgattccgttagtagtggcgagcgaacgtggatgatggctaaaacttatgtgtgtgatacccggcaggggttgcatgtaggtggttgtggggcaatgacgttcatattctgccggatgtgggcatgtgctgcgtggttagtggaagtggtgtggaaacacctgccgtagaaggtgagagtcctgtacacgaagatcatggtggtgtgtgtggttgttgataccccgagtagcagcgggctcgtggaatctgctgtgaattagccgggaccacccggtaagcctgaatacttgatatgaccgatagcggattagtaccgtgagggaatggtgaaaagtaccccgggaggggagtgaaatagtacctgaaaccgtgtgctgtcaatccgtcagagcatcctttgtggtgtgatggcgtgccttttgaagaatgagcctgcgagtcagcggcatgtcgcgaggttaacccgtgtggggtagccgtagggaaaccgaatcctaacgagggtgattttagtggcatgtcttggacccgaagcggagtgatctacccatggccagtgtgaagcagctgtaagaggttgtggaggcgcgaacccacttaggttgaaaactgaggggatgagttgtgggtaggggtgaaaggccaatcaaactccgtgatagctggttctccccgaaatgcatttaggtgcagcgtcgtgtgtttcttgccggaggtagagctactggatggtttagcgggaccaacatcttagcgacatcagccaaactccgaatgccggtaagttagagcacggcagtgagactgcgggggataagcttcgtagtcgagagggaaacagcccagatcgccggctaaggcccctaagggtgtgctaagtggaaaaggaggtggggtcgcgaagacagccaggaggttggcttagaagcagccatccttgaaagagtgcgtaatagctcactggtcgagtgattccgcgccgacaatgtagtggggcttaagtacaccgccgaagccgcggcaatgatctttataggattgttgggtaggggagcgtcgtgcatgcgttgaagctttggggtgaccttgggtggagtgtgtgcgagtgagaatgcaggcatgagtaacgaatgatgcgtgagaaacgtatccgccggatgactaagggttcctgggtcaagttaatcttcccagggtgagtcggggcctaaggcgaggccgacaggcgtagtcgatggataacgggttgatattcccgtacccgagtatgagcgaccatggtgaatcagtgatactaaccacccataagcacccgcgaaaaggctttgcttttttgtggtgtgtggttgcgtgggacctgatctggtagtagctaagtgatggggtgacgcagggaggtagctcagccacttattggattgtggtgtaagcgtgtggcacgcagtgttggtaaatccgcactgtttttgtgtgaggcgtgatgcggagcccgtaaagggtgaagtgggtgatcctgtgctgtcgagaaaagcctctagcgatgttgatattcggcccgtaccctaaaccgacacaggtagtcaggtagagaatactaaggcgttcgggtgaactgtggttaaggaactcggcaaaatgcccccgtaacttcgggagaaggggggccacggcgtgtgaacaacttttcgttgggagcgtgttgtggtcgcagagaatagagggaagcgactgtttactaaaaacacaggtccgtgcgaagacgtttaagttgatgtatacggactgacgcctgcccggtgctggaaggttaagaggaccggttaggaaaacttgttttttcgaagctgagaatttaagccccagtaaacggcggtggtaactataaccatcctaaggtagcgaaattccttgtcgggtaagttccgacctgcacgaatggcgtaacgacttccctgctgtctcaaccacaggcccggtgaaattgcagtacgagtaaagatgctcgttacgcgcggcaggacgaaaagaccccgggaccttcactatagcttggtattggtgtttgattcggtttgtgtaggataggtgggagacttcgatcatatgacgctagttgtgtgtgagtcgttggtgaaataccactctgatcggattggatgtcttaaccttggcccatgatctgggttggggacagtgcctggtgggtagtttaactggggcggttgcctcctaaaatgtaacggaggcgcccaaaggtttcctcagcttggttggtaatcaggtggtgagtgtaagtgcacaagggagcttgactgtgacactgacaggtggagcagggacgaaagtcgggactagtgatccggcacctacttgtggttgtggtgtcgctcaacggataaaaggtaccccggggataacaggctgatcttccccaagagtccatatcgacgggatggtttggcacctcgatgtcggctcgtcgcatcctggggctggagtaggtcccaagggttgggctgttcgcccattaaagcggcacgcgagctgggtttagaacgtcgtgagacagttcggtctctatccgccgcgcgcgttgaaacttgaaggaaggctgtccctagtacgagaggaccgggacggacgtacctctggtgtgccagttgttccgccaggagcagggctggttggctacgtacgggagggataaccgctgaaagcatctaagcgggaagcctgtttcgagatgaggtttcttttgaggttccctagagattatggggttgataggccagatctggaagcactgtgaggtgtggaggtgactggtactaatttaccgataacaacaaaccatttatggtttggtgtaacgcaacgtaacgaaaacagaacaatatgtgttcgcgtccattatgcagtgtctgacacagcacaaccaacctgttggttggtttggtgtgtggttgtgtcggtggtgatagtagcagggaaacgcccggtccctttccgaacccggaagctaagcctggttacgctgatggtactgcactcgggagggtgtgggagagtaggttaccgccgaccaaaaacttaaaatagtatggataagcccagaaacactgtgtgtttctgggtttattcgtgtttgagggggtgtggtggatacacatggttgtgtgttcactacaccctctcttttttgtgtttgtgggggtcttgggccccttgtgcacgtggcacctgcgcctgggggcaagcgtcgacaagcaaaaagctcgtaccttctttatttgaggaggtacgagctttatctgtcctggtgaagttttagatttttacagcgatagctggctcaggaagggtgatgctggtttgtgagactttgccagcggcttttggaataaggactgctgcggtgatggtggctgttgctgcgaatacaacgttgatgccaagtgaaactgttccggcgagtgcgacgtcggagttgatggaggtgccgtcgcgaagtgcgaggaacactgaagtggagattgcgatgccgagtgctgcgccgagggaagaggacatcttgaatacacctgcaccagcgccggtacggtctttgggaagtgttccaagcgcagtatcggtgactggggtggcgaagagtccgaggccaaggccataaagggagaagccggcgagggagatgacgatgtacgttgactcgctgaccgcggtgatcattaggagggcggtcgcggtcgctaccaagatgccagcggtgatgatcactgctcgggcgccaactttctgcatggccttttctccaactcgaatgaaaaggatgacaaaggctgcgaagccgatgctggtgagtcccgagattgttggggagacaccccatcccatttgctgaacccacatgacaacggcaactactccgccagtagcgctcataatgaagttggtgatggtcgcaccgctgaaggcgtggtctttgaaaaggttgaagtcgagaactggccagctggcgatgcgttcaatgaagacgaaaactgcaagaaatgtcaaagaaacggcaaggagagtccaggtcatccagtgcgtccagccaagtgattcaccttgggtaataaacaattcaagagatagaacactgagggcaagaacgatgatgccactccaatccaaatgcatgccaatggattgagccggacgggattccgggatgtggcgggtaagggcaatagcaacgatggagacgatcgcgcagagggcgaagattcctctccaaccaaaggggcttgctacaacaagacccgcgaaaagcgcgcagaatccggtgccaccccatgaaccaatggaccaaatggagactgctcgttggcggtcagtacctaaccaatatgtcttaactaatgctagggatgcagacatgatggccgctgctgccagtccttggagaactcggccggtgatcaccatttgggtggctaaagaagtcgttgccgtggcgatgaggagagatcccaggatgttaaggatgttgccaatcatcatgattcgtactcggccaaagacatctgcgatgccgccggctgcgacgataaatgttccacagaataacgcggcggccacgacagctatgttcatggtgccatcgctcatccctaaatcagttgccatatctgggccgatatttagggttgactgagcaaaaagccaaaatgtgagaactgataaaactatgccgatgagggctttatcatcgcctttaaaagatgtgtaagacatctaaactcccttttctatcaatctatagaaacttgcaaaatcgactttaagtcatactttctatagattgatagaaatgtggggagtgccacaaaatttaaggaggcccaactgggctgttagatgttccagtccacctgttcgggctccctggagagcacctttttgccgcggtggatgctcaaaagtacggaagcttttctctgtacagcttccttctcgctgctcgcatcaagaaccagcaggttcgccggggagttttctgcaatgtcgtaattgtccaggcctaggtttccggctggattggtggtgatgaacgatagtgcattcttcaagtggctggctgtgagcatgtgggacacgtgtaatccagaatcgagaatgcggagtagatctccatcgcccatggggtagaaggggtcattgagtgagtcctggcaaaaacttactggaattccccattcggtaagttgctttaccggtgcaacacctcgggggacgggtccttggaaaccaagtccttgcagatggaggttttcattggggcatactgcaaaacgaacctttgatgctgcgagcttgggtaaaagtcgcgccatgtagccaggtgagtaataggccatcgccacagaatgagacaccacggtttgtgcgcccatgtcacgttttgcggcttctgcggcgaggacttcgacaaatcgggaatgtggatcgtcaatttcatcagtgtggatatcgatgggggctgagtgcttctctgcaaggtcgaacagccatttcaccgactcgacgccatcgtctcgggtgggttcaaggtgtgggatgccaccaacgacatctgcacctgcagacattgcatctgagattagcttctggccaccttcgtaggcgtaaatgccattttgcgggaaggcgacaatctggatatcgcaccactcgcggacttcatcgcgcagctccgcaattgcttcgaatccagcaaacgtgggatcggtgacatctacgtgagtgcggatgaaaccaacgccgtgttctgctgcccgacgggctgcctggagggccttcgctttaatgtcttctttgatgtggaagccttgggtcttgcggtcggcccagatttcgatggcttcaaaaagtgtgccggaagagttttcgcgagggattccagcggtgtttgcgtagtcaaggtggatgtgtgcttcggcgaactggggtgcgaccagtcttcctgcggcatcgtaatcgtccgcgcggtgatcttcttctgatcgaattgaagagggggtaatcgaggaaattttttcaccctctatggtgatatcaactaactctgcgtagttcttaacctgggcgtttgtaatgcgcacaagaactccatttctacatgtcaaggcatattttcaaactctggaggatccagatgctatctattctattgcttgacaggtattagtgtggagttaaataaaaatggtgagctgtcgtagatagtttctcagcattgcctctgcgtcggggacctccgcttagccttgtccgagaacctcgatagttttcatcggggttgaggtggtcgaggtaactggtccgaggacagctgcagtatcggtgatggatgcgtctggagtgtctcccgctccactgacctcaactgatgattctgggggcttcgccttcaccagccagttgctatccgttaggctgagcttcatttccgccggagacatctgctccagaaacggctgacgcatccccaactgttcctttgagtccgcagctttctgctgctgtatccacttgtgccaaagtagcaagggtctgatttccacgatcatgaaatacagctagagcttgggcttaggcaactttgttttgataatccgcgtcgttggtccaataggcttccactgtggcacaagaaatttcaccttgagggacttggctcaggagagcaccaactgcgagtggggtaaataagcgggcagagaacttaagcatgggaaaataatgcattttgactagcgtacttctgcctagcatgcacaaagcccccacgcggatctccgtgagggttaagggatgtgaatagatttagatcttgattccgaactgtgccaagaactgttggacgatttggtatagatctggcagctgaaccccgccaactcctggaacttcaatggtgaaagttggtgatcctgcaggtgcaaggttaaccacaggggtagctgctggtgctgctggtgctgctggggcaggggcagtctgagaagtgccggtgttatcctgcggtgcaggtgctggagcggcaggcgcagcctcagttgcctcagcctgcgcagctacggtgccgcccttgagtccgcagcggtttgctgcttcgtcaacgcgtgcgagagctgcctggatctgtgggccgcgggagtcaaacattgccaaggcgttggcctgtgcaaccttgctgttgtaatcagcttcggtggtccagtacttttcagcctgggagcagctgatctcaccggatgggagggctgcgagggcgttgtcgacgatgtcagcggatgcgattgcaggagttgcaagggttgctgcaccaacgaaggttgcggtgagggctacggtcttggtttttgcagagttaagaaagctcataaccaataaccatacggatgtaactgaaatacaccagtgttgcgggtgagaattcactaacagtttaataaaccgagatgtggcttaggataggggagtgtttgatgaactcactgctcgtgcccacaattcagcgctgaggtctattgctcgcgtcgtcgcggagacggtagagccaatgggggaggatgtggcgagggtgggcgtcgtaaagcaattaaaggccgggaacgtgctggcggtgactggggctggggtgtcgacggactcgggcatccctgattatcgcggcccgaagggcagcttgagcaggcatcggccgatgacgtaccaggagtttcggcatgatccggcggcgtcgcatcgctattgggcgcggtcgtttgtggggtggcgggtgatggatcaggcgcggccgaatcgaacgcactacgccatggttgagctggagcagcatggttttttaagtggtgtggtcacccaaaatgtcgatggtttacacgcggaagcaggcacgaaaaacctggtcgcgctgcatggtgatctcgcccatgtgatgtgtttgaactgcggtttcggggaggatcgacacctctttgatgaacgtctcgaagccgccaaccccggctacgtcgcttccattcgcctggaaccgggcgcagtcaaccccgacggcgacgtcttcctcgacgaagaacaagtacgccgcttcaccatgatcggctgcttgcgctgcggctcgctcatgctcaaaccagacgtggtttacttcggcgaacccgtgcccgccgcgcgcaaaaaagatttaaaaaagcttctcgacgcctcctccagcctcttaatcgccggctcctccctagccgtcatgagtggataccggatcgtcatcgaagcgcaacgtcaaggaaaacaagtgtctgtcatcaacggcggcccaggtcgggcggattcccgcgtggacattttgtggcgcacccgcgttgcaccggcctttgatgacattttggacgcgctggacctttagacttttggtggcttaagttcgatttcacggtaccgatttcgcaagttcggtaccttgcgctcaatttctcaacggcgatttcggtttttggtggttttcctagtgatctcgctcttaagaaattggaagtatgaaatcgaacttaagtgcggagacctccgcccagacacggctacacgagtgctacagttcgacttcacgtgcgctgacttctcatactcaacttcttaacctcgacttcactcggaaaagtccgcaatccggagtggagtcagcacacgtgaagttgagctttagacaaccaccaaaacccctagttctccgcagtctcggaaatctccaccaatttgctcaaatccgccctgaccagtgcgcgtacgcggggatcgtaaggcattgcttcgtggagcacgactgaattggggtcgaggttttccacccagatgttttggacccgcttgagttcttcggggttccgggcctctaggaagcaggtttcagggggctgaatcacggtgtcaaagtgggtggcgatgcacagatatgtcacgtctggatccaaatcgccgccttcattgatggcgttgatggtgtcgtgtccgcggatcatttcaaatccagcttcgccgaaccatgattgaacgacagaattaaccacactttcgccacgattgttacggattagcgggctgacgattccgcccatggtggtgccgtgattggggacagcgagggagaccatgtgtttgactttggatgcaccacccaaaacacgcatccagtatctcagcaacacgccgccttgggagtggccaacgacaatgacttttgaggctcctgtagcaagcaatactgtatctatataggcgccaatttgtgcggatgattctgcgactgaaccggtggcgcgttggccaaattcgggtgcaaacactgcccagccgtcgcggcgtagatcggctcccaagtcttgccaatcaccttttgttgatccagttccgtggactaataccactggccaggggcggtcttcggtggggcgggcgcgccaatcgtcttcaaaaagtccacgtgaacgtatgcgcgcgagcatcggcaaggaatctgttttgtcttcgttgagtttgccgcggtttttgggatcacggtagaaatttatcgcaatctcttccactacatcgtctggcaaggcatcggcctgcggggcgttatcagtggggaggtttttccacacggaccttaacgcgtttgtgagttctcggcggagatcattgagggcgtcaaccatgtccccaacttagccgaggcgtgccacccggtcgagctctgcgcgtacgatttcgatcaccctgggatcgcgcaccatatcgttgtgggcaatcattgcgcgcgggtgttcatcttcgacccaaatattgtggactcgatttggatcatcgtcctcgttgacctccaaaaaggccacctccggaggttggatgaaaggatcaaaatgggtaccaatgcaggtgtaggtgacgcctggatcgaggtccccaccgtcggccaaaaactcgatgatgtcgtgtccgcgcagctgttcaaaaccagtgggcccgaatagtctgtgcatcagcttttcgatcgttccctctcccgatttcaccttcgtcatcgggtttaaaatgcctcccatgagcgttccgtgatttggcgtagagatggaaatcatgtgcctgaccttcatgtatccgccgtaggtgcgcatccaataccgcgccacgacaccgccttgcgaatgcccaaccagcacaatctgcgcagcgcccgtcaccaacaaaacggcatcaatatacgcaccaatttgggcagccgacgccgcaattggctcggtggcacgcgttccaaagtcaggggcaaacacggcccaacctttgctgcgcagctcagcgcccatttcctcccatgaacccttgctggccccggatccgtgaattagcacgatcggccacggtcgcgcaccacttggtcgcgcccgccaatcatcctggaaaaaccccttcggcttcagccgcgccgtcaggggcagggtgatatttgttgcgtgatcgtagagttcttgggtgaattcctccgcaaaatcctcgcgcggattccggcgcaccttagccaccccacgtgtaatcgcgcgcttgaacaaaccagaattttcctgggacatgtgctcacactagcgccgtaggccggcttgcgctcggcaagtgttttgcttatcgacgtctccccacataacaatcccaactcgaagcaccaacgattcaagccttatcagttttgtacaggaaaatagtgcaaaaatggggtttaagcttcgtggagaggattgtcatcatgaacaacgtgcaacagtttcatcgattttttgatgattccgcagtctattatccctgcttcgtcccgcttgaccgagccatcggcgaacactttgatcgtcagaacaaaccgatgtccagattcatcggaacgctcattctgccgttagccaaactggaagaagccgcccaatacaccggcgatgaagtccttcgcgtgtcggcagtaatcagtactgatgggctcgctgatctgcgaagggatttttacgaactccccaacatcgacatcgcctcggtggaaatcaagctggtcggcgcagccctcaccaacaccgcttggttgggagatgtggaaaaactcatccaacaacatcgcaacactttcgtatgggttgagattccgacagccctggtcaccgcagatattgtccgaaaactccgccacatgggagctggcctgaaatacagaactggaggtgatagggaagagctcttcccctcaccgcaggacttggtcactgtgctgcgcaccgccatcgatgctgcattgccgtttaaactcactgcaggcctgcatcgtgctctcaggtatcgtgacgagaaaaccggccgacttcacttcggattcctcaacattgcagccgccgtggcgacacttcgtgctggaaaaggcgaggcagaggcactgaagatccttgaaggcgatgatgccgctccgcttattcacgcactacaaagcggcgaaaactggcgggattccttccgcagcttcagtacctgcaatgttgttgaaccactcaacactctgattgatcttgatgtgttggcggaaggagacgtacatccctaaggatcgacgctagttagatcggtttttacgaaccttggatgcgcggttggagtcgagcagtttcctgagcaacgactccaataaatcctgctcgatgtcggtcagggtgccaaaccactcggattccaaagcattttggcgggtggctgttttctgaatgtatgtagtgcctttttcgctaaggcttaaaacctttgagcgtcgatcattttctgccgtcacctgcacaatcagagattcagcgagcaatggctttaacaggttagaaatcgcagactttttcattccagtcttgtcagtcacctggagtggactcatcgggccatcagtccacagtgaaaagagaattctataggacgccagacttagcccatcaggccgatgaattgaagagtccgcatcataggccaacagatgtgccacctgatttagagcgacagaaagctggtgtgcgttttcatttccatccggtaaaagcatgttgaaatgggagtcggcctgtcgggggtgttcatcttgagtcatcggtgcaagcttacgtcaaaatcaataaaaggccggtacacggcggttttatgcttcatttttaagggggtagatatgcagatgtagcgctactttcctctcaaaggaaagcagtatattgtcggttttttagaggctctcccaaatattgcgttgggggagctaaactaatttctgttacctgacagaaaggggcaaaattgcatatcactcctcgtgaacaagaaaaactgatgatcgtggtggcggctgaccttgcacgtcgccgtaaagatcgcggcctaaaacttaaccacccagaggccgtcgccctcatcacgtatgaactgattgaaggcgcccgtgacggacgcacagtcgcagaccttatgagctggggaagcaccattttgactagggatgatgtcttagaaggcatcccagagatgatccctgacatccaggttgaagcaacgtttgatgacggcaccaagctcgtcaccgtgcacaatcccatccgataacccttgatgtttttaggagttttgtcatgatcccaggcgagtacatcctgtccagcgaatcactcaccggaaatgttgggcgcgaggccaaaaccatcgaaatcatcaacaccggtgataggcctgtgcagattggttcgcatttccacttcgctgaagtaaaccccagcatcagctttgatcgcagtgaaggttacggcttccgccttgatattccatccggcaccgcggtgcgcctcgagccaggcgatgcccgcaccgtcaaccttgttgccattggcggtgaccgcattgttgcaggtttccgagatctcgtcgatgggccgttggaggacctcaaagtcaacgtgtgggagggacgcgaagacggttggcgtcgttcctcagctgctggtgatgctccacaagaattgccacaggtcgaagctgctgaacgtggccggaaactagatgacgccactgatgtggacacaaatgtgggcacagaagaaggctttgaagaaggtcgaaattaaatgagttttgagatttcccgcaagcagtacaccgacctttatggtccaaccgttggcgattcagtacgtcttgctgatactgagctttttctctgtgtggaaaaagattacgcagcaatcggcgaagaagtagcattcggcggtggcaaggtcattcgtgatggcatgggccaaaatggcaccttggttcgcgatgtagatattcccgataccgtcatcaccaacgtcatcgtccttgactatacgggtgtgtacaaagctgacgttgcgcttcgagatggcaaaatcttccgaatcggaaaggccggaaacccgaatgtcatggaaaacgtcgacatcgtcatcggcgttgccaccgacatcattgctggtgaaggcaaaatccttaccgcaggtggcatcgacacgcacgtgcacttcttgggcacagaccaggtcaacactgcattagcatcaggtatcaccacgatgatcggtggaggcaccggcccaagccaggcgtcgatggctacaactgtcacgccaggtcagtggaatacctacaacatgcttagtgcttttgaaggcatgcccatgaactttggcattttgggtaaaggccatggttcttccaaatctccgctggctgagcaggttcgtgcgggtgcaatcggtctgaaaattcacgaggactggggtgccacaccatcgtcgatcaacactgccctagaagtagccgatgacatggacatccaggtggcactccactccgataccttgaatgaggccggttttgtggaagacaccattgaagccattgcgggccgagtcatccataccttccacaccgaaggtgctggtggtggacacgctcctgacctaatccgagtggctgctctgccaaacgtgttgcctgcatccaccaacccaacgctcccatacacccgaaacactgttgaagagcacctggacatggtgatggttgcccaccacctcaacccagatattccagaagacgtggcttttgcggattcccgaattcgtgccgaaacgattgcagccgaagatgtgcttcacgatatgggtatcttctctatcacctcttcggattcccaggcgatgggccgagtaggagagaccatcacgcgcacgtggcaggtcgccgaccatatgaaacgcacccgtggatcactaacgggagatgctccatacaacgacaacaaccgcttgcgtcgattcatcgcaaaatacaccatcaaccctgcgattgcgcacggtgtggattatgttgtcggttcagtggaggaaggcaagttcgctgacctcgtgctgtgggatccaaagttctttggtgtgaaacctgatctggtgatcaagggtgggttgatggtcaattccctcatgggtgattccaacggttccattccaactccgcagccccgcaccctgcgcaatacttggggtgcgtttggccaggcagtttccagaagctccattacattcctatcccaggacgctatcgatgcaaatgttcctgatctgctgaatctgaggaagcagatccggggcgttcgaggtgtaaggaatctgaccaaacgagacatgaaactcaatgcagaaatgcctgatattcgtgtcgatccagagacctaccaggtgtttgtcaacggtgagttgatcaccagcaagccagcagagacagtgccaatggcacgtcgctacttcttgttctaatccgccaacaaggaaggaagatccatgattatcactgcgatcgacaccaacatctacgatcaaccggagtttgttgaaggacgcgatgtcatcggtgtgcgctttgaagatttagttttggataagcgcattcaacgggttgcactccccggaggagaagaactggggttgcggttaaaccacgggcatccgattctgcgtgaaggtgatgtgttgaaagctgatgataagacggtatttgtggtggagattatccccacggatgttttagttatcacgccaagcgatattcaccagatgggatttgtggcgcactccctgggaaacaggcacctgccagcacagttttccaagccaggtgaattgacagagaaggcagccatgatcgtgcaatacgatcacacggtggtcagcttcttggatgagcacggcatcgagtatcagcgcaccgaacttgttccgccaattcctttcaggcatagcgggcacacacattgatggatcttgacgctgattttctgctgttgcatttatcggattcagcacttccaacgggagcgtttgcgcactcatttggatttgaaacttatatggatgcagagcgaatcaccaatgcagaggagttccaagactggctgaaagtcctgcttaaggtgcaattgaccagctctgatgctttggcaatgaggatgttttacgccaccccgacggtgtctgagctgaaacggctggatgagcgcctttttgctggaactccggcgagagaaattcgggaagctaatgctcgaatgggtacgcgcatggcagagatcgtggctgaaacctactccgtgcccctgattgttgagtatctcgaattgattcaacatcgagagctatcagggcacccggctttggctttggctcttgccacccacagcgcggggattgatgtggatcgagcaatccacgctcacctcacggcaacggtgagttcgctgatccaaaatgcggttcgtggcatcccactggggcaaatggcaggtcagcgggtgatgttcgccatgcgtgagcatatcggtgcggccgtgaaacgtagcgcgaacttggatgagattgatttctgttcgggtgatccaggcttggatatttcacaaatggttcatgaaacccaacgcgcacgactatttatgagttaagaaggagaaaagaaacatgggtccaatcagaatcggcgtaggcgggccggtcggcgccggaaaaacgcagctggtagagcggattacgcgagcgcttatcgacgaagtcagcatggctgcaatcactaacgatatctacaccattgaagacgccaagattcttgccgccaatggagtgctgccagaagaacgcattgttggcattgaaactggaggatgcccacacactgcgattcgtgaagacacctccatgaatgatgcagcgatcaaagaccttgtggaacgcttcccagatctggaactcatctttgtggaatctggtggagataatctctctgcaacgttctcgccagagctggtggatttttccatctacatcatcgatgttgcccaaggtgagaagatcccgaggaaagctggccaaggcatgattaagtcggatttgtttatcattaataaaactgaccttgccccatatgttggtgccaacctagatgtcatggtggaagatgccaaagcattccgcaagaacaaaccattctgcctgactaatctgcgcaccgatgatggtttggataaggtcttggaatggatccgccatgaggtgatgatgcaggacttgcaggaagcctaaatgacacaaacccaaccagtgggaaccctgcgactgaccatcgatgatcaaggaccccaaggtcaaagccgtgcggtggagcaatttcaccagggtgcgcttcgagtcatccggccacactacttggatgattccggacaggtttgctacaccatcattgccattggtggcggatacctgggcggcgatgtgtatgagcagcaattcacgatcaaagacaacgcaaaagctttgatcaccacgcaatcggccaccaagatttatcgcacaccgcaaggaccagccacgcagcacaccgaaatcaacgtcggtgaaaatgctgtgctggaatacttggcggatcaaaccatcgcgtaccgggaggccacctatcatcaattcaccaaggtggcgctgcacccgagcgcaacgtttgtgatgagcgaacaaatcaccccaggctggcaccccgacggcaaacactttgcttacgatgaaatgcgtctacacaccgaaatcacggactccaccacagggcgactcgtgctcttggataatttactgctccggccggactcccgagagggaagttttgggtggacggaacagtacacacattcagggcagatgattgtgatgggggaaggcgtcgataagcagcttgttgctgagctgaatgagcaacttgccgcgcaccctgatgtgtacggcgccgtcaatttcttaagcgcgccgggcacgttactgcgcggatttattgcgcgcacgctgagcaaccgcactgaggagttgattaacctgcacgaacacattgcgtcgctgttgcgcgggcggtggcgcgggcaggaaccggtgaatttgcggaagtactagacggcgtcgagaaatcgaagcaccctggcggcaaggcctaaggggtgctcgaaaattgcgtagtgtccgacatcgtggagttcttcaacggtcagattttgatagatcgggccgaatgcggattccacggcagttttagtgaccgcggggtcgagatcgccggtgagaatgtacacgggcaaatcttgggtgcctaaatccgctgcgaaattacaatcagcccacgcaaaaaagtacttttcaacggcctctggagtggaattctgcaccgtcgagtcggtgagatcatccaaccacgcggcaggttggcgagatcctgaggtgaaatcgatgatggctcgcctcgagtccgggttgtgccctgctgaggtgaaaagcttccgagaatcctcatcgaatggtgttccagctgcagcaacggcagaaattccaaccagtgaagcgatgggggtggcgctgtctgcaaggactttctgcatgaacactccacccatggaatggcccaggatggaaaccttttctgcctcaatcgagtcgatgtatgcaacgatatccgctgaaatttcctccagagtaaattctcctgcgtcgtcttttctgttgccgtaacctcggtaatcccaaaagtgccaggtgtagttgccgaggtcaagatagtcagcgaaagctccccagcccgcagcatgaccaaaccaaccatttaagacaaccacatgatgaggtcctgaacctttaataagtgcagacatgtcagctcctgagagtgtgagaaacatgggacgtgctactagatttgcatcccaaagtacttgaacttttgcgctgctgcagtcggggtattcactttggctggtaacctgtagacaacatggccggccctccctatttagggatgggccggttcttaattgggttgctaactagaatttcaggtcgtaggtagaaatctaaaccacatacccgcgcttgatttgtacgccgcggattactgcggagccaagggcgagcgccgccagcgcgtacagcggaatggaggcgccaaggtgcgggaggagggcgtcgagaagcactggcagcccgaatcccaaatacgtgaacacataatagatgccgatgccggtgccacgtcggttgagtggcgtgtaagtttcgatgctgaggaggccttcgcgcaggcagaggccatatgcggtgccgaacaggatcgaggcgataacgaaaagccacactggaatggagtcgccaccaaaagctgccagcgcaaaacccgcgagggcacacagcgcgcccacgattccggagccacgaccccacgcgaatttcctacctaaaaattgtgcgatcaggcctgcgctgaaggcgatcgccgcgccgattccggggagaagaatggcgttgccgaaggtggagtcgatgcgcgcggacatcacgatcagggaggtggtgatgcagctgaacacccaaattgccatcggcaaggacaccgcgagggcctttttcatgcttcgttcgtgtttgattccgctggatgcgccaagtgcgctcggggtgctgcgggcatcgccaagcgcaaatcccacaaccaccgcgatcagcgagagggcaacgcttatggcaaagggcgtaataatgcttgtcgacgccatccccaacccacttgtcacaatcggccccatcatgaaaccggcggtcagaataatgccggccaatgtcacgccgcttgctccgcgcaatctgcccgcccatgcggtgcccgcgctgacgactaatccaacgcccagaccaacgatgaatcgtcctaccaggagggaaggaccatcatgaaacgctaaaagagaaaggtttccaagcgcagaaagtacacctccggtgagtaccaccatgcgggcaccaaaacggtcggcaagcacaccgcctgcgagcaaacttggaagaagtcccagtgcataaataccaaaagcgccgttgaccagcacgcttgatacgtctaattgttcacggatcaacaccaacactgacgcgaaatgattggctgcccatcctgcagtaaacagcaggatggtaacacctatgaagacgcgattggcgtttcctgatctcatgggtgctcactttaattcataagcagcatgttttcttgggatttcttgggttcttgggcggtctgtttccctcaaccaaaccaggtgaccaaaggagtgtatgtcgaggttcccttggtcatatgggctggttctgaagtctgataaccgtcccatatgaccagtggcgggctagccgatgcgttttcggtcacctggtttgctcggccctcaaagaggagaaaaactgcccctcggtctaaagaaagtgcccttccagaatcgctctcaagcgcctaaagcagatctgcctagaccgacacccattctgaaacttcgactctttaaacggccgttactccagaagctgctgcttttcctgcgcctgctgctcccagtactgcgacttcgcggaatcgccgaaatcttcatagatggaagacagtgcatttgcgtagtacagtgcctgctcagtggggatgccttcaaccctgaatgcagattccagcaggcttgcgccgtcagtttcgtggcccaattggaacaagtactgtgcacactgctccaactgggcagctgcattggaagggtcatcgttttgcatggccagggcagaagcgtcggctgctccgctgatgcaatcttcagggcgggcaaaagtgaagtatgcgcggttgagggattcctgcacgtatagcttctgagctgtggtttctgcgagtcccattgcggtgcccagggtttccagcgcttcggtggaaccgaggtctgcctggacgatggcgatgctgtccagcagtttcagttcagcttggtgttgatcatcaagcatttgagcataggggagagagtggttgagctcctccagcagttgctcgtgcatgttttgggtgtagaggacatccgtgatcatggtcatcgcttggactgcgagttcgaagttgccgaaccctgcggcgttttcgcgagcgtggcgcaaaattgctgcggcagcctgggggtcgtggatagcaacggtagcacccaaaggaaggagtgcttcagtttcaagttcatcaagtgtcagattctgctcgaatttaggcagcagcagcttttccaggatttcgcgggcttcaattggttcaacctgggcgagttgcatgcccaatcgcagttcttcctcacggtggggaagtcctgccgcttgaagttcctcgaaagcgagtcgtgccatttcaatggagcgttcctgcctgcccacaaatgagtaaagctgcgcgaactggctggcggtgcgggcagtggtttcacgcatgccggcgccgatcatgtacccgatagtttcatctaggatggcttcgccgtttccggtgtcttgaacaacggcatgttggccgaaaatgctgtccaaggcgagttcttgaacaaagtttccctgtgtacgaagctcctggtagcgggctacgtcgaggttctccgggctttgagcaagcaagatggtgaactcggagaactgggcctcgaggttttcgaatctcagctcaggatgggaagcggtttcctcgatgatcttgcgggcgattgcaagtggctcgtcgttttcctcgccgtatggaacaagatcgatgttgtccaatgccatttgattgatgactgcccaagacctcaagtcatcgcgaatcagttccgcttcggtgaggtaagtctggacatcggggttattcagctggtcaacagtctgggattccaagaaatcgacagcgcggtagccctggcggcgaagctccgaaaggaaaagttcgcgtccttctgcttcttttccaggctgatcaagcaaggtgatggcataagccagacgctcataatcagaaagctccgcgagctcgtcggcgttgagcaggaatcgctgcgcatcggaaaatgccctcttaccattggcgatgcagaaacggtacagtttgtcctgagcattcgcaggctcagatggggtcgcggtttgcgccttgagcagcaaattggagccgcccaatcccactggaatatccagggtggaattagcaattgaggcctcgaaacgcttcatgaaattgtcgttgccattgcgggcgtcatactcgcgcgccaggttgcgcgccaattccaggcagcgttctttaagcttttcgacgttcagatcctcatcgtggccaaacacctctccagtaccggagacaacaagatccccgaaacctgcgcgttcagtggaggacagcaacgtgtaggcgcccaagtaaaactggaaatgtcccagagttgccaaaggatccgtgatcaagcggtgctggtaacgggtgagaaagcccaagcccctggaatggtttccagtgatgccgaggaattctaggtggcgtccaacggaatcaagggactggaattctgggtttgccttcgcactgacatcttgcaggtagcgggcataatcagcatcgccggacttaagcacacgcagcatgaacgcagcgagggtggtctctggttccatgacgcagccgatggatccgtagctgatgatttgggagacgaggttttgggtttcgtcgtaatcatctgctgccattgcgagtgccgcttttcctgcaatttggcaggttgggcagtcgtcgaagggatcgtcgtgctgggaggcgtcgataagctcttgcagctctagcgcacgctcgagggagccgttcatcagggcgtcgtcgcggcgctcaatattaatcgcgatgcgcgggatacccgcgcgcgtgaagtgttcatccatctgatcgagcatgttgtccatctgctcacgggtgaacaacactgagctaatgaccaggttgagggcgtttttgtacagccaaaaaagatccgggtaggaaccgtcgccctggcctgggaagcgagccggatcgcggtcatgcatgccgacagctgcggaaaagtgggtgagcattgaggtgtgatcctcgttgatattgcccagcgtggccagaaacagtcgagctttaaactcagtatcttgatcttcggtttcctgtgccacgctcaatgcaagttgaaaagcttccatctgctcatcgttcatgggcatatcaattgcacgatctagcagcgcagtcgccgactgctcaaaggcataatccatgccctcgagattagcggaggattgtcttagatatcggatgacaaagacaaagaaaccagatctgccagcgaatcattaagcagcgcgcgttccttcacccgcagtggcctcttgctggacaacaatgcctgaacgtagagcaaacgcaccgtgcgcgacaccacggcggtgtcatcagtggacgccaatttcctgaccagcgaattgttccaattcaagcacaacgccgacagtccctgatcctgtggaatgttggctgtttgacggctcaacgtgttatccaccgttgccaaaatgtcagcccaacgatcagtggttgcgctttgtgtttcattgcgatcccgtgaggcctgcgccttggaatcaatgatcaccacggcaggaacatctgcgggttcaaaaaccctcgttgcgcccttgatctgaaaatccttcaatgattccgtgacctgcgcatccagtgccttggctttctcaatgtcctgcagcggcggaagctccatcagatccatggattcgcgcaggtcagcagtagataccgtaagcggtgggtagtgaacgggaatgagccgagccagatcgctgtcgtgaatgtagccgccattaataatcaaggtgtccgggcgcgcaatggtgttgagctgcctgaaatcatccaacgtggtagccagctgcagcgacacatcctcggtgatggacaacgtggtgatctcaccgatcgagatgcgaccacgggaggtctccaaggtgagaagacccaacatggtttcagccaggtccgcgtccgattggcacagctcgcgcagggcaagatcatgaatcgcagtaaattcccgcacgcggtgaggcttggtcatggcgagattaatcagccacgatttaatgcactcaccgatatgttccctggttgccgcgaacgcggtgtcatccatgagcgcttcacgcgatgcggtgggttccaaatcggttgaattgatttcacattccacaaagaacgcccagttgggcagcaccgtggaaggcccatcagagaccaacatgcggttgacataaatactgtgacgcctggacatatgcggagcctgggcctccggcaatacataagccacaccctcgatgccaggaccggtgagatcgatgacatcaaaaggagttttaccaaggcgctcccggccggcatacagcctgtgctgctgatcagtatcctttgcaaacaccggcgatgtagtgatggtggtgtttttctcaccctgcaccacaataggaatcggcaggtagcggccataattactagcaatggtgaccacggaattttccgtcagcaacgtgcgctcatcagggcgcggagtcaggtgcacagtcgtgcccaccggaatgacatccgttgcgtcatccccaagaatctccaggttaaaggtgccatccgcatgaccagtccaccgaatcgccgacgcaccctccgcatgcgacaccatggtgatctcatccgccaccatgaaacaactaagcagcccgatgccaaattgccccaggcgaccttcccgctgcagaccgaattcatcgcgtttcgacgtccgccccaccgtcgccagcaattcccgcgcctcctgcgcggtcaggcccgtaccattatcaaccagtgaaaacgtggcacgatccttggtcaccggccgaatacgaatactcggctcgtagccctcctcaccctgttcagaacgtgcagtacaagcatcaaccgcattctgcagcaactcacgcacatacaccctcggaccggaataaatgtggcgactcaaaagatcaacaacgccgccgaggtcaacttggaaattatcacgtgaggattcttgcatacgcctataaaagcacagttttgaatccacagggcatcagggcgtgcagaaagatagtgtggtgcgcatggaagcaacaacgatcgatgacgcaatcgcgaagctcattgacatctacgacacctcgaccaaactggccaaagaaaccctcaacaatgaggactacgccgcatacgccgatgttgtttaccccaaactcaccgttgacgtgctggaatggaaacccatcgaccgcaccgaacccttcggctatgtggatcgagccgggcgatactccgccaccttgtccaaaccacgcgtgattgagcgttacctccgcgaacaactcgagcgtctcaccagtaattatccctgcaagatttacgtatctgagtcagatatccgcatcccaccggagtacattcgcggcgcaccttccgctaccgaagctcgccgtgctggtgatgttgcagatatcatcccacgccccaccctggatgaagtccacgacgcaattatcgacggcgactggcacgccttcaacggccccgaactcccgcttttccacttcgggccgcaacgcttcgacatcgcctgcgcccgcatcgagcactacaccggcatcaacgtggaacacgtgcagaagtacattctgttcaccaactacgccatgcacaccaccgagttcgtgcattttgccatgtccgaactcacctcggaagactcccgctacgtgggtctatccttgccaaacgggcaggtaattgaccgagagaccgccaccagcctcggtacggaaacccttgatctgactagccgtttccaaatgcctcgttacgatctcatcaccgaagccggtgacggtattaccattatcaacatcggtgtgggcccatccaatgcaaaaactatcaccgactgccttgctgtgctccgcccagaagcctgggtgatgatcggccactgtgctggcatggacgcccgcatgcgcatcggcgacctcatccttggcaacgcctaccagcgcgaagaccacattctgaatacccgcatcccacttggtaatccgatcccggcaataccagaaatccaaaaagctctagaagccagcgtcgacgaaatctacggatccgacaacagcctcatgcgcaccggtacggtcttatccaccgacgaccgaaactgggaatggcacaccccagaaaacctctggaactggctcaaaggatccaccgccgcagctgttgacatggaatcttccaccttggccaccaacggatatcgataccgcattccatacggcaccctgctgagcgtctctgacctgccactacacgcagtgccgaaacttcccgcgcaagcgcaggcgttttactccaactccaaggaagcccacgtcatgtgtgctgttcgtgcaatggaatacctggcagtagatcctgaacggttgcgtacccgtaaactgcgcaggaccttgggtgaggtgccgtttcgctaaagtctcggagagttaggccagttgcgcggccatttttcagccgcgtgacgtgtcgcatcgccgaaaccttggcccactgacctgatcactcggttgagaggcgtggcaatacaaacagcaccgaggatgcgtccgttaacaatgatgggtgcactcggtgcgaaggaaggtgtcggcgtcggtaagcgccatcatgtcgcctccgttgccggtgacaagcacggtgaggcactcttgcccagcagctgtggcgacacctacggcggtggggaagccgaggccgatggattgaaggcggttcccaaaagcacgatgctgtctcgtgattccaggtcgaagtaggtgttggcccctccgatgaagtgtccgccatcggaggcgacgaacttgttagctggcaaaataccgttaagttggcgcatgaggctgtgtggatcgagtcggccgtcggctgcaagggcgtcgccgccagggcatgtcagaggattatcgtccaggtatagccggcgcggtgcgtggaaattttgtgtacgaagctttaaaagcactgcggctacaacagttgtgttatctgcgctaatgaaatggttaatgcgcgggttggtggtctgtgtttcaagatccacttggagcacttccgcgagttcaccgaaagcctccccgaatgccatggtgaattggttcaaaccggcgcccagcacaagcgccacgttggctcggcgtatttctgaagctgcaccggtcgcagcgaaacctccacatacgaccaggtcgcgagagtttcctgagggatggaagaatcctcgggcgggcgcgctggtggctacatcagctgccaaaagatctgctaattccaggatgctttgctgtgcttcgcgtgtgccacgacctgcaagagggaggggattttgggcattgcgtagagctaggacaaggtcggtgacatcgggagtttctgaaatccggggcgcagcaggtatgtagtcactgttggatcggtggctgtggcagctgctaggtcataggggatttccaggatcacgtgtgtgttttccggcgtattattccaagcctgaagagttaccgcagcaacgtcatctgcatgcacggtgaaggtttccacacctacggcacgtgcgagtccttgccggtcaatgtcgaaacagcgaggcccggcgctcggggcagtgcccacaactaaaagaagtgggatacgggagagggcgacgtcggcaagcgtggtcatggtgttggtgaaaccagcaccataggtggtggtagcgaccgccgggcggcgggtgacgcggtggtaggtgtccgcggcggccacggtttcaactgtggggcggacggtgatgatgcctcgcccgaggcgttctagggcatcgacgaaccaggcgtttccgttgcccatcaggtcgaaaacgtgatcggtgcggggcataagagttcgggcgatagtttctgaaattgagtacacagtggtctccagtaaaaggaaaattttgagggccagatgtgtctctgcccgcttgaattcaactgggctcttgttactggcactaatgttcctttttcaaacactggatcagagtacttcgccagaaaactggatcagttgaacctgaccgccgacatgttcagattggaacgcgacaaaaactgcacaagttcttagcctagtcatcgggcgagtggctttccgtgcgcgtgcttaaactgctgcgatttcaacgtcagcaagatcattgccggaagtgtcatcgaggtctattttccatttcagctggccgtcgtcttcgtctaattcaacagaatcaataattccgtctgggtattgatccagcgctaggccaatggcttgagctgcggtgactgtggctgcgtgagcttcgcggatgtcgtcatcatcatcgttgtcgcggtcgtcggtatggatctggccactggtggtgacatcaagttcaaggacttcttggccaaccacaacatcgacttcgtattgatcggaggagtcttcgcggtcaatgtcggtgatgatcctgtcggggtattgggcaaggacgatgtcgatgatgtcgaataccggatcgtcatcaatcacggcagaggtggcggtacttgaggaggtagaagtggtggcatctactgcagaagcagtttcgctggaaatggtggattctgctgttccagtatcggtggagctgcagccagcgaggataagaggagcggatatgagcgcgaggaaaagttttgcgttcttcatgtattcaaccctatgaagtgaatatgaaatgaagatgagaggttgttttaggtggcaaaacgggggtatcagcaggctgaggggaaagcgtgtgcgctgcgcttttaacaatttcagctgcgtaaaaaggggtgcggtggttaaaaatccatatttgggattatgttgggggccacatctgaaaatagttgctgggatccatcacacctacgatgcgaaacggcacccacaccgctgatcttgaaggagaaccaccatgacgtcgatgaatctgcctattgagttggctacgctgtctgaccaggctgtggacaaggtgcgctcctggctggagtacagcaaaaaggaaagcgtgcccaatgccgatgcgaagcgtctagctgcagtgttgcaggatcctaatggtttggaattcacggttggtttcgtggatcgagtggttcgaactgaggatcgtgaagcggcagcgcatgcgttgtatgagttgggcaagattgctccgtcgacgatgtcctttttggatcgggcgcagattcaggccggttctttggtggggcgggcgttgccgcaggttgtggttcctgcggcgcgggctcgaatccggcagatggttgggcacatgattgtggatgcccgcgacaagcagttcgccaaggctgtcgctgagattcagtcggatgggcaccgcctgaacatcaatttgctaggtgaagcggtgttgggccgaaaggaggcagcgaagcatttggatgacacggtgcggttgttgcgccgtccggatgtggaatatgtgtccatcaaggtctcttcggtggcatcgcagatttcgatgtggggtttcgaagacaccgttaattatgttgtggaacagctgacacctttatatatagaggccgcgcgggcgccgaaaggcacgaagttcatcaacctggacatggaggaataccgcgatctgcgcctgactatggaggtgttcaagcggctgctctccaatccagagctgcatgaactagaagccggaattgtgttgcaggcgtaccttcccgatgccctcggtgcaatccaggacttggcgcagttcggccgcgagcgcgtcaacacaggcggggcgggcgttaaggttcgcctggtcaagggtgctaatttgcctatggagcacgtccacgcgcagatcaccggctggccagttgccacagaaccttccaaacaagccaccgatgccaattacaagcgcgtcctctattggacgatgcgcaaagaaaacatggagggcctgcgcctgggcgttgccggccacaaccttttcgacatagcattcgcacatttgctctctgtggagcgtggggtagcggaccgtgtggagttcgaaatgctgcagggcatggcgtccgatcaggcgcgcgccgtcagcgttgacgtcggtgagctgctgctttacgtaccagccgtgcgcccacaagaattcgacgtggccatttcttacctcgtgcgccgcctcgaggaaaacgccgcgagcgaaaacttcatgtccgccatcttcgacctcgacgccgacaacccgtccttcaagcgagaggagagccgcttccgcgcctccatatctgacctcgccacgctcatcgacgtgcccgcgcccggccccaaccacacacaagaccgcagcaaagagacgcttctcgacgcccccctcgtcccatttatcaacgagcccgacaccaacccagcgctcatccaaaaccaacagtgggccacaaaagccgtcgccaccgcagcagagcccggttggttggaaaaacaaacaaagccggaggtgttggaagagggggacgtcgacaagctaattaacgatgtgcgcgacgctgctgaagcgtgggcagcgcgcccagcccgtgaacgcgctgagattttgtacaagaccgccgagattttgcgcgtgcgacgcggacacctgatctcagtgacggccgcggaggtgggcaaagctgtggaacaaaccgacccggaaatctctgaagccattgatttcgcccgctactacgcgcatttggccctggaattggacgacgtagacaatgcggaattcaccccagatcgcgtcgttgtggtgaccccgccctggaatttccccatcgcgatccccgctggatcgactttcgcagcactcgcggcgggcgctggcgtgatccacaaaccctcaaagcctagccaacattgctccgctgcagtggtcgaagccctctgggaagccggcgttccccgcgaggttctgcattgcatttacccagctaatcgcgatgttggatgtgcgttgatcagccatgaacacgtcgaccgcgtcattttgaccggctcctccgagaccgccgcgatgttctcctcctggcgaccagaactcaccatcaacggcgaaacctccggcaaaaacgccatcgtggtcaccccatctgccgaccgcgacctcgccgtcgccgacctggtgaaatccgccttcggccatgcaggacaaaaatgttccgcagcctccctcggcatcttggtaggcagcgtctacgaatcagaacgcttccggaaacagctggtagacgccgcatcctcactcatcgtcgactggcctaccaacccctccgcaaccgtcggaccactcaccgaactccccagcgataaactccaccacgccctaaccaccctcgaagaaggagaaagctggctgctgaaaccccgacaactcgacgacaccggccgactctggtcacccggcatcaaagaaggcgtcaaaccaggaaccttcttccacctcacagaagtattcggaccagtcctcggcctgatgaaagccaccgacctcaatgaagccatcgaattccaaaacggcaacgacttcggactcaccggcggactccaatccctcgacgccgacgaagtccgcacctggcttgaccacgtcgatgtcggaaacgcctacgtcaaccgcggcatcaccggcgccattgtccaacgccaatccttcggaggctggaaaaaatcctccgtcggcctcggatccaaagccggaggacccaactatgtcatgctcatgggaacctgggccgacgcgccaagccaccacgccccacgcgaaacaaacccgctgatcagcaaactggatctccccggagaagagctcgaatggctcgaaaaagccaacgccagcgatgaaacagcatggaacacggaattcggcagcccacgcgacccctccggcctcgatgtagaagccaacattttccgctaccgaccagcagaggtagtactccgactcgacgattccgccacaccccgagaaactgcccgcgcattgttggcagcccgtcgcgccggggttactccgcgagttcttcaaacaccaggtgtttcagagcaagtccgcgaagtattgtccgctgctggagtgagtgcagaaacagtcgatgattcggtatttatttccaacgtgttgcgcggcgaatacgacgagaactccagcgtccgagtccgctacctgggcaaagttagcgacactgtccgtgaacgcctatctgtacggcccgaagttgttctgcttgacgatgcagtaactgcctccggtcgagttgaattacgttactggctcaaagaacaagcaatttccatgacgttgcaccgttttggaaacccagttgcggccttccacgagttggcggaggaacttaaacgttgatcgttttgcgcatgggtcgctgcgtgccgatttaagggcttcgtcagtcgcagcgacctgttgtcctgatttcagttctgaaggctcttagaggcgattctagaaggggtcgaatttggggccattggggctgatgcgattcctggcagtttgcagggcaaggatccaccacgtttgagcggaaacctcggatctgtggtggattcgtgcaagattggcctctgaacttgcaaaaatccaccacgtttcgactgatcagagcaatttgtggtggatcctaaccaatctggcagtggggtcggtgaattcattattggcgggcttttcaaaggtcatatgtcgattttggggcgaaaaatcgacacgttttctcgatgtgtttaagacatcaacatatggcttgtgctactgaaagatttttcttctgaaattctgtagaaacgctcctatgctcggggcagtaagttgtgagcataggaaatggagcacggcgtgaccgttattaaaggcactgaatttgatgttttcccactaaacctcggtggaaatacctttggctggacctcgaatagggaacagaccttcgcggttttggatgcattcgtggcagcgggaggaaactttgttgacaccgccgattcttattctgcatgggttgaaggcaatgagggtggcgagtcggagcgggagctcggcgcgtggattaaggaacgtggcgcagacaagctgatcattgctaccaagtctggtgcgttggagcctgttgctggtcgttcccgtgaggcaactttcaaggctgtcgagggttccctggagcgtttgggcgtggaatcgatcgatattttttactaccactacgacgatgaggcagtcagcattgatgagcaggttgctatcgctaatgatctgattgcacagggcaagattaagcacctcgcattgtctaactacagcgcggagcgtttagctgagttctttgagaagtctgtaggcactccagcgcagccggttgctctgcaaccgcactacaacctggtgtcgaggaaggattatgaggagaacgtgcagccactcgccgagaagcatggcgttgcagtcttcccttatttcgcgcttgccgcgggtcttttgaccggaaagtacacctccaaggaggatatttcgggtaaagcgcgtgcggggcagttggatcgttacgccagcgatgaggcgtttgccgtggtgacagagttgcgtgctgttgccgatgagttgggtgttgcgccaacgactgtggcgcttgcgtggttggttgcgcatggtgtgaccgcaccgattgcgtccgtgtccaaggtagagcagttgaaggatttgatggctgtgaaggatgtggagctgagcgctgagcagcttgcacgtttggataaggtttcggagcctttcgcttaagctctcctcaaaagtaagtgatgcaagtcataacatttgcattacggttgccttatttaccgatatttattcggtgagttacttagtctggctggcatcgccggaaaaccggaccgaggttttccgcatgactgcaaaggtctgagaaatgagctcaacaacctcaaaaacctcagaaagacaacagccagacgcaccgacgagcaagctcagtaaatggagcgataaatttctcaatggtgtggaaacacttggaaacaagctgcccacaccatttacgcttttcttgatacttttcctgatcacggcgctggcttcatcgatcatggcgtggatgaacgtatccgtgattgttccaggctctgatgaggaactatttgtaaaaggcctgttcaccggtgaaggcctaacctggttgactacgaatctcggggcaaactacatcgggttcccgccgttgctcaccgtgttgccaattctgttggcagtgggtgttgctgaacgttccggcatgttggctgcgctgattaggaaactttttggttcggcgaaaaagatcgttttgccatatgcagtcggtgtgattggcgtgaccgcgtcgatcatggcggacgctgccttcgtggtggtgccacctttggccgcgatggtgtttaaagctgctggtcggcaccctgtggctgggctattgggttcgtttgcagctgtgggtgcaggatattccacagcgattgtgcccaccagccttgatgcactttttgcgggaattaccaacgccgtgatggagacacttccaggcattgcgacaactgaagtcaatccggtttctaactattacttcaatattgcatcctcgattgtgttgggtctgttatgtggtttcctcattgataaggtgctggaacctcggatgtggcgtcagaaaatcgctacggagtatgcagaaagcattgaacccaccagcgcagcagatgatgaggaaatctctgcaaccctaaccgcacaggaaaaccgcgcgctgacaatttccatgtggaccaccctggcgacggccatcatcgtgctggttgtggtgctgattccgggatccccatggagaaatgaggatggtggattcttgcctacctcgccactgctgagctctgtggtgtttattgtatttttgtttttcatggtgatgggcctggcctacggcatggtggtgggcacgatcaagaacatggatgatgtcgtgaacatgatgggcgaagcaatcaaggacatgattggtttcttggttttggccttcattttgggacagtttgtggcgctgtttaactggacgggcatcggtacctggactgctgttcagggtgctgcgggattggaagcgatcgggcttaccggattccctgcgatcattgcatttattattttggcgtcatgtttgaacctgctgattatttccggctctgcgatgtggacgctgatggctgcggtgttcgtcccgatgttcgctctgcttggctatgaaccatcattcattcaggcagcattccgcgtgggtgactcggcaactcaggtgatcacaccgctgaatccgtacatgattgtgatcctcggtttgctccgtcgatacgaaccggatgcaggtttaggcaccttgatgtcaaggcttatcccatttgtgatccctttctggctagcctgggctacattgttggcaatttggttctacgccgatttgccgcttggacctggctctgcgatcttcctcgaaggataagttttcatgagtactgacaatttttctccacaagttccgtcgactgtgtatttggattacatggagcaagggattgccgcgcgcaaagcggaggcagaatctaacgccagcacgaagggggagagcccggattatccaggccagcaggttatttggcgcctgatccaggaagcaggggagtcgttgcgtgatgaactgcgcacactggctttcacgctgcacgaccatccggaagaagcgttcgaggaggtgttcgccaccgaggaaatcacaaaacttctgcaaaatcatggttttgaggttcagagtggagtttatggtgttaaaaccgctctagaaactagttttgaaacccctggttatgatccagcgcagcacccaagcattgcgatcttggcggaatacgatgcccttccagagatcggccatgcatgcgggcacaatatcatcgcagcagctggtgttggcgcatttttagctgtcaccaacatgatcaaaactgccgaagtgaaaggcgtggatcacctcgactttgaaggccggatcgtgctgttgggaacacctgctgaggaggggcattccggcaaggaatacatgatccgaaatggcgcattcgatggcattgatgcgtcgattatgatgcacccctttggcttcgatctggcggagcatgtttgggtgggcagacgtaccatgacggcgacgttccacggtgtctctgcacacgcgtcttcgcagcctttcatgggtaaaaatgccctcgacgctgcaagtttggcgtaccagggcttcggagttttgcgtcagcaaatgccaccgagcgaccgccttcacgccattattacggaaggcggaaaccggccaagcatcattccagacactgcaacgatgtcgctgtacgtgcgttctttgttgccggaagcactcaaagacatatcgaaacgcgtggatgatgtgctcgatggggcggccttgatggcgggggttggcgtcgaaaagcaatgggatgtgcacccagctagcttgcccgtgcgcaacaatcatgtgttggcgcggcgttgggcaaaaacgcagaatctgcgtggtcgaacggcgctttcggagggtattttgcccgacactctggcagcatcgactgattttggcaatgtctcgcacctggttccgggcattcatccgatggtgaaaatttctccggaaaacgttgcgctccacaccaaggaattcgccgcttatgcgcgcacggaagaggccatcgacgcagccgtcgacgccgcaatcgggctggcgcaagtcgccgttgacgcgcttgcagatccgcaaatgcttatcgacgcgaccctcgagttcaccaactccggcgacgtacttaaagtaggggactatttggcttaggcaacgactccgaaaccttcaagaacgtgtggcactaacaattgcggactatccttgggaactgttttagattttattcagggtagggagattgttgtggatgaacgaagccggtttgcgcgcagcgttttcccggacggtgaagaaccagatccacgtttcactttggccaatgagcgcacgtttctagcatggacgcgtacgtctttggcgtttcttgccggtggtattgcttttgaggcgttccagatcagtggactatcggatactgtccgtacaacaatcgcggtttttatcattgcggttggcatgatcattgccgctggtgctgcggtgaggtggatgaatgtggagcgtgcaatgcgtaaacagaagccacttcccgtacctgcgattattccgtttctgtctattgcggctttggtggcctctgcggctgtcttggttctgattattgttcagtagctatgcgcattcatgaggatccaggtttgcagcctgaacggactgtgttggcatggaatcgtacgacggtgtccttggctgtgtgttcggcaattttgctgaggtggactaatttctatgggatttttgcactgctgccggtggtgattctcagcggaatggcgattttcatcttgtttacgcagcgggttcgttatgaacgtcaggctatcgggcttgcggataataaattgccacctaatatagttggggttgtttctttaacggtgacacttttggcgttcggggccgctggaattgtattcgtcttcattgattaaaacgtttgtgttgcaaagtagtaacaggtctataacttttgtaatgaggggtttcttctttgcgatattgatgcgattatggcaactaacgcccaagggattgggttggtaaggcttctggttggtgtcgcgattcttgctagcgtattggatgagcaatgagcccattgtcctccagtcagaagaaacccctcaccgggttacacctaaacccggtgaggggtttttgctgcgtcagtttgggtctagttttaagccctcagcagtctatgagcagtttaggacagttccgctggagcttcctgtagcggcatagtcgtccaggtgccattgtcataggtggcaacggaagtcgggacaatcgacattgaattgttcgggttgcgccggtagataagcacgatgctctctgaagaagttgctgacataacctcgccctggtgtccctcggcgatacccaggctgggaagctcggccccgctgacctggtcgaagaaacatatgtgagtgtcttccgacagataagcaaccgtccccttgctcttccatccggatgcggagatatctagctctttggtagaaatgacctccagtttggagttgagccggtattcctctacccacctgcccacgatgtattcatcaccgatctgaaccacagaactgatggtatagccgttgggcgggagttcaccgatgtcgacgccaccggtcgcattaactcgaccgagggcggtgcgtctactagtttccacctgcagctcaaacagaccttggccacggacagcgacgatctcccagggggaggggacctgaggcagatcggttgcccgggtgggaggagtccaatcaggagctttagtggctactgcttgaccaggtgtgagaatccaaccactcttcccacttgccgctacggctcctaattgttggtcgctgtgcagctcaaggacgtacgatcgatctcgcagtggtgctgggactaaagtctgccccaagtatcggccggtcgtggtctcccagcagcgggctaccggaaagtgcacgtcacacagccacaatttgtcacccgccacaataggatcgacagcagtgaagacgtcacgtctaagcggaggcggaacagctccatccaacgtgacgtctaaaacgacatcgcggatccaccaatcttccgagtgataagccgaagaagtattgtctatctcctgccacaaacgctcgttggtgccacttgtgccgataccagcgaaaatacgctctacccgtagatctgtgggaacatcaacaattccgtaggcggaataataaaaccacccctggatctctgcatctccacgttttgggatgggagtgtaggccagcgccgtccacccatcaccagtgagcaggattggccactggggcataccgtcatcgcctggactagcttcttccccaaggttgcgtacccggccccggcgtctggttgtcattccttcgagtggcacaggggaggagctaattcccaaagtaagtcgcacagattgtccttgacggtagtcagggaaatcaccttcgagtgctatctcattgacgaagactcgtagtctgcgaggatcttcagactgcggcggcagtgactgaatgtaaccgggtatttcagcaacatcaggggcagtgtgtggtgtcgaatctggataatggaatggttcccaggctccgtcccaggaaggattaggaagagtgtcaggaaaagaaatctccgtggcttcgagtcgttcttgtccagtctccactgcaaggatgacaccgtgttcctggtcgatttcaagactgaccaatcgacttgggtcctgccctcctgaagtaggttcctcacggaggatccaggtggggcgtccagcaatctctcccgcagtgatcttatccgcgtgaaggtggtgggataaggaccgggagatggaatgctgttgaagaacccaggccaaggcgctcgggcagatgatatcccgaggacccaatcgaacaggtgggtcaatgggtttattgaaattctcaaatacccagcaatgatgctcgttgcggcgcagaatatcgctaccgttacgcaggacgtggaggctgttagggctgcgtcgtatctcgacttcatcgggatcgacgaggaagatcatcgtctcgcccacgatatacccgccactaaaagacattttcccggcctccaaggaagaggcagtgagggtcatgatcactgattgtcgctcaccgcgacgaagcagaacatggatgtcggtgatcgttggtgccatgctgcacagtatagagagttttctggccaggacttttagcaatggttggtcgtgtgacgtgatggtttcccgcagtgtcagagcctagcgtgggcccagtgcctctaaatttaagaagtagcctagaagtgcctgattattgatgcagcctgttagggtctgccccgagttggagaaatttttttaacaatcctttcacttgggcaggccttttggggatgtttagaactgctcagcaaccatgaagagttaacttcgttgctcgtcaggggcgggaacagtaataacctgcacgccgagatcccggatctcggcgagaatctcccgtggcgcatcggaggttgtgaccagctggtgtaagtccgcgacgtctgcgaaacggaaagtggaaacgtggttgagtttacgggcggacaccacaaggattcgtcgggtggcagcatggatggctgcgcgcttgttttccgcatcgtcgtaggtagtggtggccaacccgtgctccagtgatgtagagcaggaaccgaggatcacgacatcggcggagaaatctcgtaacgcggtgatcacagccgggccagataaggcgagtgagtcgttttccacggggccgccggggatgaaaacgttggtgccagctcggcttcccagggcgaccgccgaatgtagagacagacacaatgccgtgatgggacgccccgccaactcttgggccactgcctggcaggtggtgccgttgtcgaaaattactgcttcatcatcagcgattagttgggcggtggcctgggccaaaatgcgtttggcctctcggtcctcagcctggcgcacggcaaacggttggggagtaccgcgtttgggcacacgtttcgctccaccgtgggtgcgggcgaggaaacctgcttgctctagctcgacgagatcccggtgaatggtcaccgcggaaaccccagttagttcagtaagagcatcaatgcgtgtgattccggggcggtcgatcgttcgcatgatcactttgtgtcgttgttcgcgctccatgtgatcagaattcgctaattcctaaagaatgtcaaccctgacctaaccgaatgaacactggttaaaatgccttttcgtgcaaattctggggtcacgggacaagtgggaataccccgccgtataggggtttaaatgatcatttttagtgaccgaataatcatttacactgtggcctatgaacaaccaagaaggcattcagaagtcgatggtgaccagcacagttaccagtgggaaagtggttcctaccagtcagtcggataaacggtgggccctgaggtgggagtggtttcaacgcaccggcctgaagataactggccagtttttggagagataaaaacgccactttggtgtcgataacaccgaacttccgaacataaaagatgcgttggtgctctctgcacaatgtttctttcggaactattctggcgaccatgcgaattgaaatcacaagcgtatttgttgatgaccaggccaaagcactcgatttctacaccacgaagctcggatttgagctcaaacacgatgtaactgctggtgactaccgctggttgactgttgttgatccagaaaacccagatggtgtgcagcttttgttggaaccaaaccagcacccagatgcagcgacttaccaagctggaattaaacgagacggtattcccgctacacagttttatgttgatgatgtgcaggaagaatatgacagcctcaaggataaaggcgtggatttcatcatggaaccaaccgatgtgggcccttcagtgattgccattctcgatgacaccgtaggaaacctaattcagattgttcaattgaagcagaactaaccccgtggaatgacaaaatctgtcaaccgagcagagtttctctcaagttttgaccaaggggtgttaaattccaacaccgcaatggcgctggtgggaaacttttcttccatctgatcccaaccgggatgttcatcgcggatgccaaaataatgggctagttcttccacgcctggccagtgcccgatgagtagggcggtaccaactacatctgggagccctgttattaaatgtttaaattcagacacttggttttcatagatgtcattgtggaagctagagcctttggcggttgcgccaccaagctggacgcgttcccacgttaattgtgtgcgggtggcatctgaacacagcacatgatcaatttcgccgatgttgccagctagccattggccagctgccacgccatcgcgaagcccacgttgattaagtgggcgtttatggtcgagtactccggtggaccaggaagatttggcgtgtctaaggatgacgaggcgatgtgtgggagacatgcctcaaccctagcgcgcaacggatttagacagttacctgcgtaagaagtgcatcgatggttgcttccgcgccacggtcatgaagggaggacagtgtctcggagtatgccttggtgaatggttcagcatcgaccaagtctccgaagattccacggtcgcggatgaatgacaaaatatcggtgcgatttcctgatgcgttttcttggacgcgctcactcaaacggtcaacaatctttattgggttgccctgctcgtcggtgccttctgcgtagcgcgcccaggatgcgacgatggctgcagaaagtgtgacgtcgcggcctgctgcgaggttttcgcgtacgactggcaacagccactttggaatgcggtcggaggattccgcacacaggcgcggtacggtgtctttgactgcggcgttgccgaatcgcgcgatgagttggcgtcgataagcatctagatcgacacctggaagttccttgagggtaggggtggcttcgcgctccatgtaagccaggaggaaatcctggaagcgggtatccgccatgacgtcgtggaccatgtggtggccagccaagtggccgaagtagcaaagtccctggtgggaggcgttgagcaggcgcagcttcattaattcataaggctccacgtcggagacgacctgcacgccaacctcctcgtacgcggggcggccctgggtgaaggcatcctcgaggacccattgggtgaaatcttcagaaaccactggccacgcatcgatgtagccgatttccttgatgtcatcgcggtcgccgtcggtggtttcaggggtgatgcggtccaccatggagttggggaaggccacgttgttttccacccattcgccgagctcagaagacacggaatgtgcgaaggcgaggaagaaacgcttagccagatcgccgttgccttggatgttatcgcagctcatgatggtaaatggcgtagatcctgattcttttcgggaaatcaatgcggcagtgatcaacccaaagaaggtctgcaaagtggaagtatcgcccgcctgcagggcttcgcggtcagcaacgattcgagggttggtgtggtcgaaatcttctgtcgccggatcgatgttgtatccgccttcagtcaccgtgagggaaacaatgcggatggagtcctgcgcgagggttgcaacggcccgtgctgggtcctcgggagcgaacacgtagtcaatgatggatccgatgattttttgatcaagagttccatcaggagctttagtggtcagggtataaaggtgatcttggctggccagggcatcgcgcatgcgcacatcggaaggcatgacacccatgccgatgatgccccaatccaaggccttgccctcattcatcaattcattgaggtacatcgcttggtgagcgcgatggaatccgccaacaccgaagtggacaatgcccggggcgacgtcagcgcggttgaacgctgggatctgcactccggaagtcgaagcgatttcctgcaggttttcagtgttgagctggagtggggtgttcatggtggaaaagatcctttcaaggatgggtttagctcgaaaaacagttaggcgtttgcgtttacatctgcaaggtcttcgatgtgggcgtcttcagcaagtgctggcactccgtcgaatcctggttgggtgccgcgaagttgaagagtcatccaaccggagagcaggtagagggcgatcatgaccaggatcaatccggttggaccaatcagtgggtggaagactgcaaccaggagcggtcccacagctacagcgccaccaacgccgaggttgtatgtggccatcgctgcgccggggtgcttgggatcaagggagacagcgattgcggaaagtggcacgaagcccgcgagggacacaccaaagagtgcgccggctgcgatggtgattccgaaaacgacaccgttggacatgccagcctgaacgccgaacatcggaatgaagtaaaccaacgcgagggtgactgcgccaccgattgatccgccccagaacacagttcgtgcccaaccgtggcggtcgccgaagctaccgaagaaaggattgaacggcaggttgactgcgtaaattacagtggtgaggatgaggaaccagcttagctgccacttcagatcgtcagtgaaaaatgatgggaagaacacagccatcgcgtaggtcggaatggagttgatggtgcggatgtaggtgacaaaacgtgcacgtcgatcattgcgcagaagtttgaagccctggccaagtgtttgcttcacatcgtcggggttggcaaccagtgggtggcgtccgcgacgttccttcactcccagcagtgcgatgagcgatccgatgaccaccagcacgagggaaacccacaacgtttcatagaaggtcaagttcacgtactgcatggaaatggtggcaaccagcgcacccaaggtaggaagacctgcagagaaggcaacgtagaaccaacccacaccggtacccaattgcttaggtgaggcagttgcggtgatccacaccaagaatccgtaggcgaagaatggataaccaaagccgcggagaccataagcaaggaagatcaaccaagtatggtcggtggtcagtgccacggtgaggaagatcagctcaaagacgatccagattgaagcaccgaggatcatcacttttcgtggaccccacaggtccgaaagtgccgccgcgaagaatgctgcgatcgccacggcaacaccgtaaacagtcaccagggttcccgcgagggaaacgctgaaaccatgttcggaactgaggaaaggttccaaaatgttggtttcgacaccgtcaccgatcatgaagatggtgaggccgataaatccgaaaatcaagggtcggggaatgccgagacgttcgagcaacccgctttgctgtactgacatgtgttcacctttgttttaaatgttgagtccagcgctaaagcatcagaagccaaaagccagaagctaaaaacactgagaaaccgtcacgttaaatccgtgttagattcaacaaaatctggcttagcttcagcgctgaactcacaattccgattagttcgtggtgcgaatcacgtgaaactaacaacaatctaacgccatcatgttataaaaaagcaagacctaacataaaaatgttagaaagtgctggatctaacaacatttccgtggtaactttttcacatgtcccaagtgattcccgccagctcacaagaaaagcgtcgtgagcgcatcgtttcttatgtcacccgtcatggattcgctcgtgttgaagcattagctgagctttttgaggtcagcgcaatgaccattcaccgtgatttggaggcgctggctgcagacaatttggtggagcgcattaggggtggcgcgcgttcggtgtcgccgtcgatgagtgagttggcagtggagcagcgtcggcatttgcatcgcactgttaaagaggcgttgtgtactgcagcagcacggttgattccggagggcgctgtggtggcgattgatgattccaccacgttggagtctttggttgagaagttgccgcagcggtcaccatcggcgttgattacgcattctttgaagacaatggcggatcatcgtgtgcgcgccgggatgagcgatatccgtttgattgcgtgtgcgggattgtatttcgcggagactgattctttcttgggcaaggcaacttcagcgcagttgaatgagctgtcggcggatatttcttttgtttctacgactgcggtgcgcgctacgggggaggttccggcgctgtttcatcctgatatggaggctgctgatacgaagcgggcgttgattgggattggtagcgtgcgtgtgttggtggtggattctagtaaatttggttcggctggtgtgttcaaggttgcttcgattgaggagtttgaccacatcatcattgatcagcagtgcacccgtgagcagcgggatcttttgcgtaattcgcgcgcgcagatccatgtgattgaccacaatggtgatgaaattttggataccccaacggaagaggatttttaagatggctttggttcttggaatcgatagttccacccaatcctgcaaggctttgcttgtcgacgccgccaccggccaggttatcgacgaaggccgcgcgagtcacccgagcgggtcggaggtagatccacgtgcgtggatcgctgcgctggatcaagctaccgaggggttgttagaacgcgcggacgctgtatctattgcaggccagcagcacggcatggtggcgttggatgaaaacgatgaaatcgttcgcccggcgttgttatggaatgacactcgttctgcccaggctgcgttggatctcaatgaggagatcggcggcgatcaggctgcggtagatgccacgggaagtgtgtatgttgcttctttaactgccaccaaaatgcggtggatgcgtgatcatgaaccagaaaatgcagcgcgcacggcgtcggtgatgttgcctcatgatttcctcacctggcatttgatgggacgcggacgcaaagtcaccgaccatggtgatgcttctggaacgggctactacagcacgcgtgatcgtgcgtggcgcaccgatctagctgccttggcgctgggccatgaggtggaacttcctgaactcctggccccaaatgcgattgcgggaacaactccaggtggagtgaaagttgctgcaggcacgggagataatgctgcggctgcgcttggccttgatttgcagcctggtgatgtcagcgtgtcgatcggcacctctggcgttgccggcatgaccgttcaacatagcgtccacgatccatctggtttggtcactggtttcgccgatgccacgggtgcgtatttcccgctggcctgcacgcttaatggcgcaccggtgttggaattcggccgccgcattctgggcgtggaatgggaagagttcgatgcgcttgcactggctgctcaacccggttcaggtggcgtgacgctccagccttatttggagggcgagcgtacgccgaatcgtcccgcagcacgtggcgttttggctggactaaactgtgcaacgacccgcgaggactttgcccgagcaactgttgaaggcttgttgttggcattggatgatgctgtaacggcgctggttgaggccacgggagtgcccgttcagcgcatccagctcatcggtggcggcgcgcgttcacaggcggttcgtgagattgcccctgagattttcggccatgagattgtggttccagaacccgctgaatatgtggcgttgggtgcagctcgtcaggcggcatgggcgctgtcgggtgaggccacgccaccgcagtggccaactcccggttccgatccgcaccgcgcacctaaaaacactgagctgagcacgcgttatgcgaagctgcgtgctgcaacgcagggttggtactagagctcgatattgtcgatcaaccgcaccggccccacgaaaatcgcgccgaccaccaacgctggttgggtgagcaggccgtcgatttctaatggttcgagggtggctggatcgacaatttccaggtgatccaagcgcacgccgtcggcgctggccaaggtgtcgcgcgcaccttggatatctagcgcttcaccagctgcttttcgacgctgcaacccactcaacacctgcggcagcaccagagcttgcgctcgctgatccgcagaaagacgttgattgcggctggattcggctaagccatcggcgccacgaataatcggaacgggacgaatctccacgggaatgtctagatcggcaaccaatcgccgaatcaccgcaacctgctgagcatctttttgtccaaaatatgcacgatcagggcgcaccaaattgaacagcttcgccaccacggtagccacaccatcgaaatggccaggcctgctggcaccctccaattttgttccgatggaaccggtgcgcgcccacactagtggcaagccaccggggtacatttcctccacatcgggtgcgaacacaatatccacacctgcctcttcaagcagtgctaaatcggcgtcgagttggcggggatagttgcggtaatcatcgcaatcaccgagtgcttcaaactgcaggggattgacaaaaatactggctacaacagtgtcgttttcagcgcgtgctgctttaaccaacgaggcgtgtccgctgtgtagcgcacccatggtggggacgagcccgacggatttgtggtggaggagggcgtcgataagcgcctgctttgtggttgctacctgcattaaaaggactccgcttcgcctgggaaggtacccgcgtggatatcggcgatgtaggcctgcgcggcgtcgtgcaaggaatcgcccaaggtggcgtactcgcggacgaagcgtggcttcttgccgcggttgaggccgaaggcatcctgccacaccaaaacctgcccatctgtgccattgccggcaccgattccgatagtggtgatggaaagatcctcggtaacctcgcgcgctgcctctgctggaaccatctccaacacaaccgcaaacgcacccgcctgctccaacgcgcgggcatcggcgatgagctttccagaactcgcgccacgaccctgaaccacgtggccgcccaaggaatgctcggactgcggggtgtacccgatgtggccgacaaccggaattccagcatcaacaatgcgtcgaatcgtctgcgcgatctccacgccaccctcgatcttcaccgcagccgcacccgtttcacgcatgacccggatcgcggactccaccgcctgatttgggctcacctcataggtaccaaacggcagatcaaccaccacaagcgcacgcttcgtagcgatcgtcaccgccttggccagcacaatcatctcatccaaggtgatcgacaaggtggtatcgcgacccagcacaacgttggcagcggaatcaccaacaaggagcatatcgacgccagcctcatcaaaaatgcgcgccgaaagcgcatcatagctggtgagaaccgaaactttctggccgtttactttagcttcgcggaaatgacgggtgcggattttctttgcatcaatgcctgacatgggcatgagtatagatgtgatgaccagctcagaataaataaattccgatttgattcactgttcaggggtgttgctcgattaagttctcgttatggagtcaaatttttacctcaagacctactatctcacgacctttatccgtgagcgcaaaccgcaaagggcgtttgctgacctcgtgaactaattccatttctcggagagttctaaaatacctcgttgcagttgccttagaaactttaagaaactttgctgccgattcaagtgaaagtgtttcgtccttaccgaaaagctgaatctggccgagaatgtacaacagattgatctgatggttcttaaaggaattggtaccccgaagcgttttaatggcgtcctcaaggcttgccaaaaagtcgattctttgttttatattctcaatgagaccttcttgcgctgcaattaacagctcaagcatggaaataacaaacggtgttccgtctccgcgatttaatcggtgttctacggcatgaaacgctttgtagtacttgtttcgaaattgattaattgccgaagacattgtcagtgctgtagcaggggagagaattttgcttaattgtatcccgagaaggtagcgcccagttcttccgtttccatcataaaacgggtgaattgattcaaacatgaagtgtgacatcatgatgccaacaaggttggattcctcttctgagtgcgccagcttaataattgcgttgattccttcgatgatctgtgattctggagaaaaacctgaatgaatcactttttgccgactatcgcggatttccacgggtccttggcggaaaatctcaccatctaattcattttctttacctagctcgccgtgcattaaatggtcatagagttctcgaagttcacttgggctttccggaaaggatattttaccttcggcaagtgcgaggtaaaggtgtgaaatttccgaaaatctctttggctcactagtggaagattcatcaagcgctatttcaatatcccgacgagttgagtgaatattttcaatctcatttgttgaaatcacttcatcgattgtgagtgagcggtaataatgtcgaatgacaccgggtgggagccttgaccaatagtagagaattgtcctctctaaattatggcttctttcggttagtcgataaacttccggggtaataagacaaaacagtgggttatttttaaccttaaattcccatttaagtgctgcttcggaattgaatcgactttgatatagcgtctctgctgcggattgatgtagagcttagtgatccttctccagagtcctgtagtccatgtcaaatcctttataaacaaaaatggccaatttgcagtttagaagttgccttaaccgttcttaattgacaaaagttgtcattttgtcaattaaggtatttaagactttatctttaatttacaaattaagcttgtttgttaaataggaaacttaccggaattagtggattgagttactccttcggataccctcggcgaccactgactgttggatcattgggaatccaaaatcttaaaagtgcttcggtgttcttgctgatgccaatgcgggggcctcgcacaatttcgggtgtttcaacacggtcagaaattaaaaatgagggaccaaaaactgaagcatggttgtcgctgatttctaaaccgagcgcttgtccaaaatttcctgggccttgcgcaagacgtgcatgaggaattccttcccctcgtcggctctgtgcaattgattcccctgaaaccacttcaccagcacgaagaagtacgccttgacctgttccttctggcccgcacacaatatttcccgctcggtgaatcccataagaaatatagacgtacatgtgaccaccggggccaaacatcgcggcattccttggggttttgccacggtaggtgtgtgcagcttcgtcggtcgaatctaaatatgcctccacttcggtgatacgaataccaacgcctccatgtgtgagtgtgcatcccagaagttgtggggcaacaatatcggcgggttggaggaagtcgataggcatggcgccgattctaggtcgaactgatctaaagtcccaccacgcaaaagtaaccaaggcgtacatctacccggcactttaagatcagtggcatgagcacttcttttgagtccattcccggagttactatctccgctcgaaaagccttgagcactgcggggtttaaagatctggaatcgcttgcaggtaccaattacgaagaagtggctggtctgtcaggaattggcgcacgtactttggagcgattgcaagcagcgctggtggagaagagaatgagctttggcggtaaagtgccagaggcagaacagcgcaccgcgacgtggacaacgctagattctgcagcaccagaggcaacagaaacctcagaatccccagagtacttcattcaaaacctagacattcctcgcagaattacccacggccggttgttgttggaaattttcaacagagcgacaggccagaaaccttatgtagcagggtcttcgattgttggttatgggcgagttcattatcgctatgccacgggtagggaagggatcactattcgtgtgggtttcagtccgcgaaaggcaaagatttcactttatggactaaccagtgcgcctgcgtctcgagaacttctgaagaaattgggtaagcattctgttggtgtgtcctgcctatatatcaacaaaccagaggatgttgatcttgaggtgcttgaggaaatgatccgtatttcttgggaagcggaacctggcgaatgttaaatctcaacctttaacaaagtgctgcttccaattcggcgcggatgagtcgtcgagcagcccgcgcatcggaactgattccccctaggttaataaaggcgtggatctgtcctttgaattcagtcatcgtcacggaatttccagcctctagtagagcttgtccataggctcgcacttcatgggctaacacgtcgcattcgccgtacacaatggtggtgggtgggaggtcgctcaaatcagatgccagtagcggtgagagtcgagggtcggtgcggtcgtgcccatcggcatattgttcgatgtagcgttccatcgcgtcctttgtcaggtagcaatctttgccaaatgtgagatagctcggcgtagatgtagtggaaacatcagttaccggaaaaataagcacctggtgagccaatacaggagtagaacccacagcccgttcacgcagctgttgtgcagtaaccgcggcaatatttccaccggcactgtcaccgccaattgccactcgggaagtatcaatactcagcccagacaccccatccaatacggcactgaccactgcaaacgcgtcgtcgatagccgctggaaatgggtgtgcgggtgcaagtcggtagtccacgctgatggcgatgatcggcaggccaaccactagagagtgaaccgtggcatcgatcatgttgagggtgccgccggaccagccaccgccgtggaagtacaccaaacacggcaaatccccagccccagataaaggcgtataaaccctcaccggcaccccagcaatatcttgatctgtcgccacatgggttgcatcagcctctgaaacaggagcgtctttaccaaaactcacctgctcctccgcgctgagagtgggcaaggtatcgatataaaactgcgcatctgggtgaaggagcataacgacaatcctagaagccttaggcaagaaatttggttgagttttcgatctctacgacgcgtcatctcaattccacctaggcttggatgcaggttagaaaggagccttcgatgtctaagactcgtacttttctgtttgatctttatggtgttctcatcaaggagcatggtgcggcgcagtttgagcgggttgcgcgtgcggtgggggagccgtccaagaacgacaagctgcatgaggtttatgagtcgcttcgtctggatctggatgccggccgcgtgagtgaggtgaattattggaatcagatcaaactattggtgggtttggagtttttggatatccaggaggtcatcgcggctgactacaggggcctttatgagcgtgatcaggacatggttgattatgtgttgtcgttgaaggcgaaaggccaccgcatcggaattttgtcgaatattccggaggggttggccaagctgttgaaggagcacaattcggagtggcttgatcagcttgatgcggtgactttgtcgtgcgatattggcgcggcgaagccggagccgaagtctttccatgtggcacttgaggcccttggtgaaaaagctgaggatgtgacctttattgatgatcgcgtgcgtaacattgaggcagcgcgcgaagaaggtctcagcacaattcacttcactggcttagattccttaaaagaaagcattcaggaatgacacctcaaccactgattttgcctttcggcgataaagttccgcggatccatgaaagcgcatggattgccccgaatgccacgattatcggggatgtcgagattggcccggatgcgtccattttttatggcgttgtcctgcgcggtgacgtcaacaaaatcaccatcggcgcccgcaccaacgtccaggacaattgtgttctccacgtcgatggcgatgcgccgtgcaccctcggcgacgatgtcacggtcggccacatggcgcttgttcacggcgcgacggtgggcaacggcacgcttgtcggcatgaaatctgcgctgctttccggcagccacgtcggcgccggcgcactcattgccgctggtgcggtggtgctggagggccatgaaatcccggcgaaagctttagcggccggggttccggccaaagtgcgcagattgcttgacgacgcccagtcccagtcatttatcccccacgcgggccgctatgtagaaacatcaaaagcccaggcttccatcgcggaagcactgagcttagatgaggttagggtacgagagtaagtggctcgttgagtagtcgatcaagtgcgactgctcgagctgctgcgcggacgttttcccggtgggtggggatcaaccggagctcaatgtctgcgtcgtattccttcttcaattgggaagcgaacaccgaccgaccttgtggatcttcggaaaacgccgatcccgagagaaccagggtggatggcttaactgtttcggcagcttctgcggcagtgtgagccagcagggtcgcgcgatcgttgaggaattcccgtgcggtttcattgtctttagcaatggtgactagctcaccaaggctgttggcaaagataccctgatcagaaaccctgcttaagaaaccttgggtgctcagcgcatcttcggcagccatgcccaaagtatccaaacctgatccacgagttgtagccagtggtccaatgacatgtactcccaaatcattgctgtaggccgcgcccacagagtcatcggcgtagaaggtcaaggtgatgggagttggctgctcagggtggggaagtggggaagcctgcagttcagaagctgcgatggcaggaattgctgatgccacggttgctggaacgctgaattggtagttcaggcggccagcgatatcaacgccatcccagcccaagttgcttgcggtgacaacgcctgcgttggtgacttttcctgaggtggcaacaccaatacctaccagtggtagatcaagaccagtggtgaggcggttgacaccagcaatgaggtgttcgatgaaagtgtctggatctaaatcagctgctgagatttccagcatggcatcacgaagggtgcgacccttggtatcaaacaaagcgacgtaggaagacttggtgccgattgccacgcctgcatgaatccatggacttggagcgagttctagaggaatattgggacgaccagggcccgatgagagtgtgagatcagggcgttcacgaaccaaacctgcctgcattaaagcggtgactgcgcgggtgacagtcggttgggacagacctgtggcctcgaccagctcatttctaatgagttgctggccgaggcggatatggtgcatgcactttgcagccggggtagaggggcgggcaaaggacgcagagaagtgggcctgattgggcataggtaaaccatagccaatcatagacaacgctgtctaataggggtcttgttatctagaccgcattgtctgtaaatgggcatggataagtatttagatgccggtaatttttggtttctcgtatttccagaatttaggcaccgccaccatacaaattgcagtgagtacaaccaccgctactccgccccataataccgtccaacctgcgccgaggggctcagcggcccaaccgtgaaggacgtcagctaaacgaggtccacccaccacgacgatgatccacacaccttggattcggccctgcacatgttccgcagcagactgctgcaaaatagcgtttcgaactgccgagctgaacatgtcagccatgccaccaatgaccatcatgatgatgaacatccacgcccacgcagtcaccgcgccggggctgacaacaattgccacaccacccaaagcaacggctgcgccccaggcgatgatgcaccaataaactgcaacaccctggcggctaatccgggccacccaaccagacagcacgccgccaagaactgcgccaacagccatggatgagtacatgaacgccagcatcgttgcaccggcgtcacccccaccgaagttcacttctgcgatctcggggtaaagcgcacgtggcatgccgaaaatcatggcgataagatccagcaccatcaccatcaacaacacgggttggccagccaaatacttcaggccatccaccacactggcgaaaccagccttcatcaccttgccggatggcttgatcgaaggcagtgaccatacagcccacagtgtggggatgatggagacaacatcaaggaaatacagccacccgaaaccgatcagcggaatcaacgcacctgcgatcagcgggccaacgattgcgccggtctgcatgagcagcatattcagtgatgttgccgacgctaattgatcaatcggcaaaatacttcgaaggatcgccgttcgggtgggttgattcaccgcgaaaaatgcctgctgtaaagaaaagtttattaacaggagccaaatattctcattgcctaaaatggtcagcacccaaaaaccggcagtggtgacacacatgccgatcgtggtgcagatcagcacgatgcgtttatcaaaagcatccgcaatggatccaccataaaggccaaaaataaccaaaggaataaggccaaaaagcccggtcaagcccacatagccggaggacccagtcatttggtaaatctgcaccggaacggcaacaacagttaattgggcaccaatgacggtggcaacattgccaagccagaggcgtttgaaggccggttctttcagcggtctggtgtcagcgaaaatatctcggaaactcaccaggtagagcttagacctctttgttgggcctatttgttagtaacctcggcgatcctccacagaccaagcgccgctgacaacggctgtggtgtcaccgcgcagcagatcctcaatttctgaggcggcgtgtagaacaacatctagtcggaaaccagcaggaagtggcgtcccctctttgagaagggcatcgccgaagaaggaaccacctcgacgggtcgggccgccgacgcgagcgatggccaatgcccccgcggtctcggcttcaatgagcatcgtggtggaatcagcgtcctgagatgcgcaggttgtcgaccatacctgggggacatgatggcaaaacacgtggccaaggcacatgacgatttccgcgaacgcatcgcgaccaagatgcttgccgacgcgaaactggtaccaggcgttgtccggcgtgacagtcgagggcggggtatccccgacgatgactggtgggtgggggagttcggcccagcttgcggcgtcgacaagcgtcttttcccaggtggcaaccgcgccaattttggctaggttgcccagcatgcgggcggtgtcgtcggtaaatgaggggtgaaagcctgcgtagctgggagtggcgtggaagggaccgcggtggcgcctggaagcgtcaatgtgtggatcggtgagcggagcgtggcgtggattgaggtggcacagcagtggtggcgtaaggggggtcgcgcaggtcactgagcaaaatgggcagcgtgtcgggggattcgggaaatcccatgatgtcccattcgagggcggggcgaagatcgatgtggtggagtgcgtgcttgacgccttcaaagctctggagctcaaaaacccgcattggcctggctaattgcaccgcggcctgggctgcgtgggcaatggggtagtggggccaggcgctggcggtggcgtaaatgagctgctcgaggcggcttttacggcgcggattggtttcggtgctaaccatgtcagagatggagcgaaggacggttgcggtctcagggtggttcatggcggtgcgggctcccaactgttgattcacattcattggaaataaggttagcctaaccattttttgcagtctagggatttattgaagtttcgccgcgtgtgcggtttttattgtgtttttatgtataaataagttaattacgccttttttacctaggcggactagctggtgattcagtaggatttcatttcgaatagatgtggctgaagacaagaatgaatagcattcatctcgtcgaatttcatgtagaaatttgtcccccttttttttgatgtgaaagttgaatcggtaagctcctgtgaaaattaaatccgtatttttgagcaccgctttaagcgcttccttactgctcgggatcaccccacccgtgctgggagcaacgatcaaccccagtttgcctctttctgcgttgagctcctcggacgatatcgccgtacccaacttcgccaaagaattaccgttagcttttgatgtaccagcaggcactgttccccaaagcttgagtggaacgctgcagattcctgccgagttttctggcggcgtcgtggagttttatgacggtgaccggctctttcacaccctgcgcctagaagttaatgattcccgagcacacattgaggttccgctgcaaagcgttcctgtcgaagacggccgcgccaccttttggttgcgcgccatgttggatcctgtaaacaaccagtggtgctacgaggagcaggaagtccgcttcttagacggaaacgtcacctttgaaggggcgacgattaacccagctgtggtggctgattacttcccgtcagtgctgcgcgcgttgacaatttacgtcccggaaaacccctctgaggcagtacaagaagccacgttagaggttgcgacctccctggattcggtgtaccgaagatcaggtctggatgtcaacgtagaaacgcttccaaccggcaccgatgctcctcctacacgtcctcaagattttgaacgccagattgtgctggttgacgaggcaacagaaagtaacacgcaaaaaaccgaattggtcaatcccggccaagacaatgcattcttgcgcctgaacggcaacgccgacgagctttacgatcaagcgcgcttgcttaccgacgcaaccctgccacttgccgtagacaccgaagtaacggcctcaggttttggtgatgtgcccaacctttctacagatgtggccaccctccaagaactgggtatcacgcagctcacctctgaatcagttgcgcgcacaagcgtcaccttgggcattgaacgctcccgcctgcggacctactcgcagtccatggacctgcacataacgggaacctacaccccattgccaccccaaaatgcaggacagatcacgttctccattggtgacaccgtgttggactccttgaccaccgatgacactggcatcattgaccgtgagttcaacgttcctggagacttggtcaaccgctacacggcgatcgtcgtggaattcaccagcaccggcgacgttaattgtggggtcacccagcccgtaggcctcaacattgattccgacagccttgtcacctcccaacattcagatgttcctgtactcaacggcttccggtccctaccgcagtccttccaacctcgtgtggacgtggcgtttgctgatcccagcgtgcaggaactctcccgcgctgtcagcgtagtgttgggaattcaatctatgagctcccagcgcatccgcccacacctggttaactgggatgaagccgtagccagcgagcgcccaacaattttcattgatgctgcgggcgcaaagactgatcaagtgccaagctacctcgcccaacaaggccaaaccctagagatcaccagcaagaacgaccaaaatgcggacggcgaacaactcacccgatccctgcaaaccaacgctgcgcttgttgtcggttccattcaggccgtgtgggatgccgataagaagcgcacggtgattgtggcaagttcccaggacaaccccgccgatttggatgccttgatttcgtggatgggagaagaccgcgaacgctggagtgatctcaacggcgacctgattgtcaaagtccgagaccgcgaacctgtgcaattgaccaccgtggaagccccagatcagcctggtcgatcggccacagcctttattgcgatcggcgtcagccttgtggtcattgccctgattgtcgcagccgtggtgtcagtgtccaggcgttcgcaaaaaggatacaaatgatttcttctttacccagtagaacgcaggggaggaggttgggtccatgagtaacccgtcgctagaacctctagaaccgatcgagctttctgacggtactgaaattgaagtttcagacgttgatccagaaccgcaagctggcaatgcgcagatggaagtacccagcttacggacatatgtttttcgcggaatcattgccattgcctgtttgatcattggtttttatgagagctttgtgctgatgtggcaaaacctccgaatcggcgtggccaactactcactacttgtggtgctcatggcgatcgtgttgtttatcggactggaccgcaagcgtgctcgtgcattgaacattcacgaccgcgaagtcgactacatcattggtggcattgtcgtactgatagccatcacgattaagagccagcttctgccacgttttgtggactgggaaactctgctgcgcttggatatgttcgcactgttattctttgcgtttggtatttccggcctggtgtttggcatgcgctctaccttttcttttgcacccggctggattttgctgtttggctacaacgcggtggcacacctgatcatctcggtgattttcggtggtggcttttggggcccggtgatggcaaacatcattggactgtctcttgcggtgttggtgtcctccaacagggacctggttcaggccacctatttggcactgatgacggtgttgtttggcgtcattattgccatcatcgtgtgggcgctgaccgatggcagtaagttcctcaccttggtcccagcagtgctggcaaccatcactgtggtgttggtgtcttcgcgttggaggcttggtcagtggaaaattcgtcgtagacaacccacggtggaaaaagccggacccgcgcttatcgcggtcgtggttgcgacagcactcttggcgtggattcctactccttatgtggagcgcgtcaacaacctccccgggcttcaaatgctggcaaagcctgccccaggtgttatcgcacctattggttggcacatcgacgatgtgcagtattacaactgggcttcgcgctacttcggccccggttcctctctgcttaggcagacgatgacggcagatcattacaacgaggcgtgggatccagatggactcgaccgaactgttgtggtggataccctccaatcggcggaacggttccagcagcgtgcctttggtgacgagacgctgtattccactctgagaggtcgaaagtcagataccgtccaggtggatctgggatacggcgtggacggacgcgcctacacggtgctcgatgaaactgacttcttgacgtacaccaagctggtttttgaatggcagaccaccaacaacaccgtggagaagatctccgtcatcgcggtggatgatcaccgcgcagaagcgaagttcccggagcttgcaccatcggttaccagaatgtttatccaggtggctaccattttgttccgtggaaatgacgtgaccatcgataccaatacccaattgaaagatcttgacctggtcagccaagttggccgtcagatcgtggcagaacaacaggtggggaggtcatgatggaacaagatctcagctaccgtgaaattcttcccctcaacgcgagtgaggagaagaaaaaggctgcactgattgatgccattgaagggttaagggtgcgcgatccgctactctctgcctcgattgcatttactagagggcagaaagtcgccttcattgctgtggtggtgggctttatcttgatgctcatttttgctcggcaagcagcacttattggactgtcagcaacgtgtacgttcatgtacctcattacattgttggacagatttatcatgttttccagaggtatccgcgcggaatccatcatccaggtatcggatgaagatgcgctggctttccctgaggacaagctgaaaacctacacggtgttggtgcccgcctatggcgaacctgaggtgattgcgcagctgctggcatccatgcacgcttttgattaccccaagcatcttctgcaggtattgctcatgttggaggaagatgatctgcccacgatcgccgcggcagaggcagcgggagtggatcaggtggcaacgatcattaaggtgccgccagcgcagccccgcaccaagccgaaggcctgtaactatggattgcactttgccacgggggaaattgtcacgatctttgacgcggaagacatgccagatcccctccaactgcgtcgcgtggtggtggcatttgaacgctcggcttccaatacggtgtgcgtccagtcaaggttgtcgtatcgaaacgccaggcagaatctgctaactgcgtggttcaccattgaatatgacgtgtggtttaacttcctgctgccaggcgtcatgcgcatgaacgcacctgtcccattgggcggtacctccaaccatctgctcacgggtgtcctgaaagatctcggcgcgtgggatcctttcaatgtcacagaagatgcggacctcggcgtacgcatcgcggcaaagggatattccaccgcggtgttggattcggtgacgtgggaggaagcaaactccgacaccatcaactggttgcgccagcgttctcgctggtacaagggctatctgcaaacatggcttgtgtatatgcgcaggccaaagtggttagtccaagagcttggcatcattcctgctgtgcgttttaccttcctcatggcaggcaccccgatcattgcggtgctcaatctgctcttttggtacttgtcgctcacgtggattctgggccagcccggcaccattgagcagatgttcccacctgcggtgtactacccagcgttggtgtgtttggtggtgggcaatgctgcgaccatctttatgaatctcattggctgccgggaaggccgcgaccccttgctgctcatcgcggttctcacgttcccgctgtattggctgctcatgagcattgcagcgttgaaaggcacgtggcaattgatcacgcgaccatcctattgggagaaaactgcccacggattggaggcgtaagcggtgcccatcgtcaaaccaatgccggcactgcccaggcgcgcgcccgtcctggcgagttcgcagatcgaagggtttgaacaccgtagagggtggcgtcgacaagcaaatttctggtttgctgcaagccttgccctgtactggtgcgccgcgctgtggatcgcgctggacgttgggtatttctggggcgacgcgctctcgcgcacccagggcgccctatccgcgctgtactcgcgcaaccccacgttgtcggcgatcggttacgtgtttacccctctgaccaccgtgttgcagattccattggtggcgctgagcccctgggtcccggaattcacgcgcgccgggttggcaggcgcattggtgtcatcagtgttcatggcggcttcagtgaggcaattgtggttgattgccagcgagcgtaacatccggtattggctcgcggtggtaggccttctgttgtatgcacttaacccaatgatcatcctgtacggcgcgacgggaatgagcgaagctccgttcatttacgccactctctgggcggtgcgcaggctgattcgctggacttctaccgacgacgtccacgacctcattacctgtggttttgcgttggcattggcgtttttagcgcgctatgacgccctcatcatggccttcgtagccatgtggactgtcggatttatgacatggcgcgcacgataccgccgtggcttccgcgaccgcatcggattcgcacttgtcgacatgctgctcctcgtctggccgatcggcttcgccttcgtcgcctggactggcgccagctggctcactaccggcgaactctttgcccaattcacctccacagacggcaacgctgcgatcatcgcagcatccggcggcggcgccatagggccccaagcgcttttcgacgcctccgtccgcaccttcctcatctccccagctctcctactcgtcgcagtagttgcagtcttttttgcttatcgacgccgcgaccccgaacccatcatccccttagctctcatcggctctgtggtgttcttccaaatcattacctactcacttggatctaccttcggcctgctgcgctttttcctcaccgccctgccgctcaccattatcttgctgttccaaattatcccgccccgccaccgattcccctcactgcgaccaggtgcgtgctaccgcgatcgcgtcaccggcaagtacgtgcccaaaacaatcaccggtgttttagttctcgcgatcttcggcggcaccggcatcaccctgtacggcatgagcagtgctaactgggcgccccaggaatatgccatccaagaactagttttcaacatgggatcgccatcgcaggacgccgtccacaccctgaacaccttctccactgaaatggatgtcgccgatttcgtcgactccctaaaccttggagacggcgaagtccttctctccaccacctacggcttcgccgtcctcaccgcatcaaacaaccaaaagcaattcatcatcccctccgacgaagacttcatcaccaccctcaacgaacccgctgagcacggcgttaagtacatcctcgccctcccacgcgaaggtcgcggcgccaccgacccgatcaacctgcgctacccagacatgtatgaaaccggcagccacatcgccacgatggaaatcgaattcatcaatcaaggccaaggacaaccaaattggcgcctctatcgggtgctcaccacacctgaacagtcgtagactctttgtaactaccgttgttgtttttccatatccaggagagtcatggcccgcaagctgaaggacaaacttccccgaagttttgacaaaatcgtcgaatcgggcgattttgacgctttcaaagaggtcttcaccgagcgcgccctcgacgccaaaaaccgtcatggcaacactgccctccacatgcgtggagtacctgaagaattcaagatttggatgcttgaccagggcctcgatgtggatatccgcaacgaagacggcgacaccccgctgcacgtgcactcccatgactggaacttaagccccgattttctgctcaaacgcggcgccgatgtctgcgcagtcaacaatgaaggcgaatcggttgcctactccgctgccttcttcccagaaaacctcaaaaagcttatcgacgccggcgccgacccctactcgcgcgccaacgacggcaccacgccgctgatgcgtgtcattcgaagcgccgacaccggacaaatcatcgaactagcagaaataaccaagctactttccggcacagaattcaccgacgcagaattccgagaaacccaagaacgcatcatcgcaatgggtgaaagattcgaagatgtccgggaagtctacaacgaagaatccgtcgaccaagcatctgcggacatgatctggctctacgatcgtttcgacatccccgaagaactccgcgccaacacaccaattttgcacgacggagtaagcccaatagaactgcctggggatacctggcaagaacaattcatcgaaggctacgatctcctcgttcccgcaatgggcaaagcgaaatccctgcaaggcgaagccatccgaattgccggacgagtatccaacgaatttcacggcaacggtggcgtcaactgggacaaagacttcaaacgcatggccaaatctctcaaccacatttgtgagcagggcgttcctttgggtgagccagaattagaagaactggctgcggccgttaaatcagtgcgcaaaggagaacccaccgaggaggagatcgacacccttccacggttggccaccaaatgggtcgcacaaaacccacaaccgctgccactgggagaggttgactacaagcgctgaacgttgagtttgagtttggtccattgaggggtaaaggcttacctctcgactaggtggggtgggcgtagagcgcctattctgattgatcgtgttaaccatcgctattgtacttctcgcgtcagtcctcatcggtgctcttctccaacgcatgacaggattgggcgtcggtctagttaccggcccagtcctgacttctttgttagggccgctagcaggcgtgaccatggtgaatggtctgtccatcatcaacgcggtgaataatgcgtggtcggtgcgcaaacgcactgactgggccaaattccgaattcttgccggcgctttggtgcttggttctgttcctgctgttgcagtggtgtatttccttaacggaccatggctgttgattttcgttggtgcgatggtgctgctcgcgttgggtgtttccctgttcccaacagagaaattcgcactcaagcaagaagctaaactgcctatggtcatcttcggcatgattggtggattcatgtccactgttgcaggcatcgcagggccatccctgactgtttatgcgcgcctgagccgctgggattaccgcgactttgtggccaccttgcacccagttctactcgtggccaacaccgtatcgttcctgctcaaggttatcttgatcggtggactcgatttcggtggcgcacccgcatggctctggatcggtgccgtagcgatgatctttgtcggtgcttggttgggtgaaatcgtcaacgctaaggtgtccaccccaatggccaagcgcatcgctacgctcctggcagcagctggtgccgcagtggtgttgttccgaggcatcatggaattggtttagcggtcttaattggtgggaagttgagcagaagttaatcggtctcgaggttttttcgagaccttcgtatcccatcaaatcccagtaacgccagggcgcacgccagtagtgagtagacaatggcgtcgctgagattcaacgtttcaccaagtaatagtgctgcaacaaacagcaagattggttcaccataactgagcaggccaaacatcggcatactaagcagagttgaggcggctagatacaacgccatagctaatgcgccagcgaggcccgccagaataaccattgacaacatggcgttagacagcggatcctcgacagtggcgagcatgaaaaatgccaggggacttaacgctaaaacttctgcgccgtaagcaaaagcgttgttcagccccgagtatttacgaagcgcaaaatacagtgcataacccgcagcgatggcaaaagttacccacgataattgcgcactaatgacaaatttcaaggttactgcgatcagcgcgattcccaccgcaatccactgcagcctggtgatgtaatcagcgaagaaaaaccgccccacaattactaggaaaatgggcagtaacaggtaaccaagtgaggcatctaaagcatgactcttaggcgaccaagaaaacagccacagctgaagcgtgatgagtacaacgaggaagataaagtacagaatttgacgaggttgggaccttagtgtgtcccaaaattccttaaacaccttccgaccagcagggtgcagaagggcaagcaaatagcatgccgctgttagaaggacacgccaagcaacaagtgtttccgcctttgcctcaatcgccccagagatgaaaaagatcgctccgaacaaagcggatgcgagaacagacgtgatgacaccagcggaagatgtacgatttgttgccactatcagctcctcgtttccttcattagcttcgcatatgtctggatcttattggatgtatgagtcagagatcagggagatcgcgcactaaccgaacctggccagtgcaacaggattatgtttaaagcatggatcttgcactggctcaggttgattccaccgtttcggggctttatgacgccctcgatctcatcggcgtgctgctgaacggaataatcggtggaacgatcgccaggcaacgaggctatgacatcattggctttctgttcctggcgttattttctgcgctgggtggcggaatgatccgtgacatgctgattcagcaggggactgtcgcggcgatcgataatcagatctaccttgcgctcgcgttttctggcgcgctgattgccatggcggtgaactttaaaggcagggtgtgggagctgtttaaagttcacggcgatgccattgtgttgggcgtctgggcggtgacgggttccgtgaaggcgatgaatgcgggggtggctccgctgccgagtattttcatgggcgtgctcaccgcggtgggtggtggcatggtgcgtgatgtggctactggccagacgccgacgatttttggtggcggaactctttacgctgtgcctgcgacgctttctgccacgtcaatggttatttttcatagctttgaccaggtaattctgggtatgattatttcaccgttcttgggtatcgcgttggcggttactgcgtattggtgcggttgggtcattccggtgaacacggatttcgcgccggtgaatctgacggtcagccaattgcgggcaatgctgtccaaagcggagcgtaaagataaggatcagaaatgaaaacttatgcagtactaattgcggtggcagggttggcacttgctgggtgtagctcgtcggctcctggaatctggcgtgccactgaacccgcagatgcctaccttgaaatagccgatgacggcacgctgtccggaaccgacggctgcaacagactttttggtggctgggaaaaagacggctctaccatcactttcggcgccatcggtatgacagaaatgtactgcgaaggcgtcaacgattggctgtcccagatgcacaccgccaccgtcaccgatgccaccatgaccattttcaacgaggccggcagcaatattggcgagctaaaacgctaaatgcttctcgacgtcaaaagcccggatccaggtagtgcttccgcaagatcgttgccgagcgcaacgatgcggttgtcggcgtccacgtgcacaatctttggctcatacgccttggcttccgcatcagttgcctgaaggtagctcatgatgatcacaagatcgccaggattaataaggtgtgcagcggcaccattgatgcaaatattgcccgttccggcgtcgcccacaatgacataagtttccagacgagcgccgttggtgatgtctacgatggcaactttttcgccttcgatcaatccggcggcgtgaaccaggtcggcgtcgatggttacagagccaacataatctagatcagcttgagtgacagtggctcggtgaatcttacttccgaggatggtgcgcagcatgtcctgtggtgtccttatgggggttgtcctgcaagttttagaaatcatagcgtgagatgacaaggaaaggaatatttcgatccggcaacaacccccgcgtcaggtgggattatgccgaaaaaatcgctacgatagccacttatgactcttcagagttctgataaacgttctccttcactgttagacgcctcctccgaggtctttgtccatgatttggcagctttgtctcccactgatgccactgcatggggtatctcaggcttcgaaggtgatcttcaggatttctctcctgactattggaatgccatcgccgaacgcaaccgcgacatggttgccgatgttgatgcttttgatgacggcactgatgacaacgatgacgaagaagatttcgatgacgttgaccgcgtcaccgctgatgttctccgtgatcgcgtatgcctggatctggccctgcaccaccagggcgaaaccttagcgaatctcaacaacattgattccccagtccagaccatccgcgataccttcctcatcatgccccgcgagacggacgatgatgtggaaaatctccgcgaacgtctctcccgcgtccccgacgctctccacggatactgtgaatcactcgctgaggctgccagccaaggccatgttgcagcggtccgccaggtggaagaagtggtgtcgcaatgtgaggacctcgctgatgaggactccgttttgcagcaccttggcttggatgaaaatgatccagtagttgtagaggcccaggaagcttttgcacgagttgccggttggttagcagagcaactggctccgcatgctcctcatgtggatgcggttggccgggatcgctatgaaatgttctcccacctgcacgtcggcgagtttgtagatctggatgaggcttaccaatggtccctggaacagctgcgtgacattgatgctcagcagcttcaggtagcccagcagctgtacggccctggcaccacgatccgtgaggccatgaagaagctcaatgctgatgagcgctacctcatccgaggcactgatgctctgcaggagtggatgcaaaagaccgctgatcaggcaatcgctgatctagatggcgtttccttcaacattccagagcaggctcgacaggttgagtgcctcatcgatcctgctggaactggcggcattttctacaccccaccaagcgatgatttctccaggcctggccgcatgtggtggtctgtgcctaaaacccaggaagtcttccacacctggcaagagctcaccaccgtgttccacgagggtgttcctggccaccacctgcagatctcccaaactttggtggaaaaggatctgaacctgtggcgtcgagtcgcttgctggaactctggccacggtgaaggttgggcgctgtacgcagaatctctcatgaaggaattgggataccacgaagatccaggcaacctcatgggctaccttgatgctcagcgactccgtgcagcccgcgtggccattgacatcggaattcacctgaacaagaggaacccagagtgcaccggcctgtgggatgcgtcttatgcgcgcagcttcctgcgtgaaaatacgtccatgaatgaagatgcgctgtactttgagctcaaccgttaccttggttggccaggtcaggccgcatcgtatgccattggtcagcgactctggttgaacctgcgcgatgaggccattagccaggggcaaaccttggcgcaattccacagcaaggcattgtcctatggcagcatcccgatgggcattttgcgcgatcaggtgctgaactagaaggcctttaacgatccctacgcaaaatgcgtcgcagtagcgtggggatcaaaccggcgatggtcaagattgccagtagtcgaatgatctggatcgtgaccaccaccgggcctgcagatccttccgaggacagcgccaacaccgtctccagagctccagggctggttgctaggtaagcctcgaagaagctgatatccaaccaccaggtgagcagccccgccgcacctgcgcacaccgcaagcagcgcgaaaataaacaagaacgtggccggaagctgcttagaaaacaccttcagcgcggtcatattcaaggcaccgccacacatccaaccgatcgccatgaacgcgataatcttaaacacggttggcggttgcaggctgagatcatctggaatcacaaaactcaccagcacggtcaggatcagcggccccatcaccgcaggggcaggcaagcgcagcaacctgccgagaggttcgccggccagcacaataccgaagagcaccagcagcgataaaacgcttatcgacgtcccgaactctcccaaactcaacacgtccaaccatttctcaggcggcgatcccaaatccgccccgccagggacgaaaaagtgcgtcaccagcggcaacgtcatggacacaaccaacaacctgaggtactgcgtcagcgccacatagcggaaatcagcgcccaactctcgggccagaatcggcatcaccgacgcgccacccgccagcatggacagcacaccagtttccggcaaaatctccggcctggatcttgccagcaacaaaccaccaacgatgcctaccgcgatggtgaaaaaggaaatcacaagacccgggatgaggaaacgaacaagttccgaaccagaagaactaatcaaaggcagcgccgccagcatcgccacgattgagcgaccaaaaacatgcacccccttggccatcggaagatcttgccctgtggtcagcgcacatacaccggcaacaaggatcgccccgaggatccatgcggctggcacaccccacatagtaaaaagccaccccacggctagcgacagcggcgctacgatgcaccaacgaagtgcaataaccttgcgggatggcttctctggaatttgttcgtgggggtctggttctttatcgctcaattgggcaccggactccttgatccacgtttatttcataatgtcgctttcactttagcagcggaatcggtcaacacttcataggagtcaggcgtgatcagcactggtaaaacatcaggatcggtagcataaaagcgaacctcattctcaccaggaacaaccacaagcctattgacagtgatgggcttagtgatgctggtgggcgcaatcatcgtggtgatcaacggctgcttgctggctgtcaccgagagttcaccgtcttgagcctgggtgatttcaagtttcgcggcttgttcgtgagcgccgtcgagaagcttccaggtcaccgggaaagtcgcagcacagctggcgacgacgtgcgcttcggtggagggctcatcgaaaagcacgcaggtaagcttttgctcgtcgcccatgtcaatggaatagagtccgtttccagctgtcgccggggtggcagcgatcgcgggcgtggcggcggtgagcaggaccaaagctgcgaccgcagcgattgtttgattacgcatatgaatcatccttaaccgtccagaaatactggtgattcccatgctaatccgcgaaaatggcacttcaacagccatatactttaaacaacacaaatgatgcaagactgataccgggatgtgataggagcgcaccacatggggttggaattagcagctagcgggtggggcatcctcatcgcaggcgccgccgtagccggatggatcgacgcagtaatcggcggtggcggactcgtcctcatcccgctgatcctcgcggtcatgccgcaactcgcacctgtgacagcgctggcctccaacaaactggcagccgtcaccggcacggcatcggcggcattcaccctggtcaggcgcgtcaaacccgacaaaaaactgcttgcgctctacgttctggtggcagctgtgtgctccggtgcaggcgccctggctgcgagtctcattgacaaacaaatcatgcgaccgctgatcatcgtgttgatgctggtcgttggcctgatcgtggtgttcaaaccaaacttcggaaccggcgaaagcaaagccctgcccaccggatggaaacgctgggccgccatcgttgcagtcggactcatcgcagcctacgacggcatcttcggacccggaaccggcatgttcctcatcatggcgttcaccgcactgctctcccaaaatttcctgtcctccgcagccatggcgaaggtcgtaaacaccgcaacaaacctgggtgcgctaattgtattcatcatcggcggccacatgtggtggaccctaggactcgtgctggcagtcgccaatgtcgcaggcgcacaactcggtgcccgaacggtgcttggtggcggtaccaggctaattagatacgcactactaaccctggttgtcgtcatgagcgtctacctcacctggcaacaaatccaaggaatgtagataagtcggggcaaactctaagaaatcatcctggtttgtggcagggaacattcctaggatgggaggcatggcaaagacaaaactagaaagcatctccgagcgcaactcggatgatccgcttagttaccccgacctgactcttgcaccaatatccacaacagtcacagtcgtggtcgccgaagacaccccaaacgataacttctcagaacttctcctcggcgcagcagaatcaacccgtcttttaggactcgacgagctccacatcatcgctccatcagtccacctacccgctctcgcagtagcagccgccgacatcgcacaccatctgccagagaaattccaattctgtgaagccgaaacctgcactcatctccaccccgacgatgacacctatctcacggctgaatccgttgctcaattgggtacgaagctgaagtctgcgtagttgttaggagccaccacagacccgtagattcttgggcggtgtggtgaatccttgccctggaaccttgcgggagactctcagaaatgagtcattggggcttggggtgtggtgaaacgcaaacatccgtccccggaccgcggtaaaaggccgattttgatcgaaaattcctgctaatccgacattgaaatacaaatactcgttcgcttttaagttttctcggtgatccgtaacgagaagttgaacagcaaacccgcagcaactgttcagaaatcacaacagtcccaatgacctcaaaatcggccccttctagaatcgcctctcagggcctttgagcgctaaattggggcaacaggtcactgcgtacaaagagggccttaaatcggctcacatcaagtcgtgccaaaactacatgcgattcttggtgcgcgcagtggcaggagcggtccatggatcctccggccacgggtgtttggggtaccggccccgcatttctgcacggacttggctgtacgggccagaccagaaactacgcaggtcatcggtaactgcaagaggtcttcccgcaggtgacaggagatgaaattgcaccgggattccgcagagctgcggggattcttctaatccgaagcattcttgtaatttcactcgtataactggcctgcctgatgaataatctagtcggtgctgattcccgctgggtacggataggtgggaaggagcgaattcttcaaagttggttgcttcaggccaggggagaagtcgctggagtgcgggatacatatcgatattgtttagtcgtgttccgtggctgagcgcctcaatttctggagataaccacaggtgcgggtccgcagtttcaatatctggccagggttcgccacggtgttcgtggatgaatttcagtcggtcacgcaaggatgccgctttgtcggagaagtggaataggtcgattccgcctttggcaagggctgtggcgattgtttccgaggcttcggcgggtgttggttttgtcggagtggaacttaattcgatcgcgcctgctgctttgaccttccgggcttggacttttccgttgacaaaaatcgcgcgggtttcttccacgactccgatgatgtctatggcatcgtcctctgaaatgcgggcggcggcgcggatgatggcagaattttgtgagcggttaattgcagcaacggagatccattcggcatctttgagatctgaatccatgaggcgtgcgcgggttccactggctaaaaggtattctccattgtctatttttcggccgatgagctgcgggaatgcagcgcctacgatttgccccgcactcgcttttccaaccgacgcaggtgccaaacggcgaaggcgttccacttcacgcttgtcgggttgttgcttttcgacgtccccctgcgggttttcggacaccaccgccaagatttttgcggattgttcaccgaagcggaggagagaagcgctgagttgagggcagaggggaagcgtcgataagcgatgtcccaggctcgtgatagcgtcaccttcaagcgcgccgatgaggcgcaggatctgttgtgcagccgtccaggctgcgtgagggggttgatcaagaagcggtaaatccgcaggtgacgttccccattgggcgagccagagggctgcttgggtgaggtcagcggagctgatttctggtgtcacaaatcgtgggaagtgggagaagtcttcttcggaatagcatctgattatttgtcctggtccttcacggccagcgcgacctgcgcgttggcctgctgaagcctgcgcgcaactgctggtgatcagtcctgtcatgccgcgggcagagtctcgtttggggcttcgtgagaggccggaatccaccacgatgcgaactccaggcacagttagggagctttccgcaacgggagtggagacaatgatgcgctgctgttgtgacggtgcgagggcgcggtcttgttcggtcgggctgagttggccatgaagtgggaaaacattattatggccgagcgatttgagcgtgctcattactcgatcaatttcacgcacacctgggacgaaaatgagtgcagagtgctctgaatgtgtcaccgcatcgtgagttttctgcgccatgtggtcgaggaaatcccagtcgacaccttttgcattgaggcgaggcgcgcgggctggagcataagaaatgtctaaggggaaaatcggtgcttcaacactaaggacctgagcgtctaataagtttgcgaatttatctgaatctaaggttgcggacatggcgatgagggagaaatcgtcgcgcagttgactgagttcagcaagcattcctagcagtagatcggaatcgagttgacgttcgtggacttcatcgataatcacagcgccgatgccgggtaattctgggttgtttaagagctggcggattaacacaccgggggtcataaattgcacgtgggagcctgaaatatgttcaccacgcacgctgaatcccacttttgttccgagctggctatcatctagttgggcgagtctgcgagctgctgctcggacggccacacgacgaggtgccgttactaaaaccttggttggggtggcatttcccgctccttcattacataagatgttagctactaatggggggagaagtgtcgtttttcctgtgccgggaggggcctgaatgacaaggtttttaggtccggccgaaaaagcttcttgcaggtgagggataatattttctacgggcaggcccgtggaaatgcgatttataagaaaattgccaattcttgaactcatcaattgcctgtacattaagaatttgctgagtgaacacatctttttcctaacttctacagagaaacctaaggcgatgatgtgttttctagcgggttgtggaaagtaaatttttccttcgtggcgaagcggatatccccacaaagagatgtcattttctaacgtaagggcactgtcctttcaagagttgcgccaggggttgtgctcttatatctaaccgtatcgacaagattcattatggaatggaaagtaggaaagtcattgtgggctgtgctgagaaacaagacttcaccaaacttttatcaaaacaaaagaccaggtggactcccacagcactgatttctctcggttgtatcgttgtcgctattttagctttagtagttttccatggttcttccaggtcgtgcatctttcaccaagtaatttgccctttgattctgggaatttctggagcaattgcaggaatcgtcgcaaagaaaccactgctgactggcattaatctcggcttcgcattcttcttagtgcctgcgtatttaatatttttcggcaatattttctgacagcctaggtgattttgtaggaagaatccccaacgcatccacggaagcaccttctggcagctgcgaacgttcgagccggctatcatcacgtttccgcactactcgcgcagggttgcccacagcaatagaatcatccggaatatccttggtcaccacggcccccgcgccaatcacacacctatcgccaatgctcacgccaccaacgacggtgacatttccacccagccacgtatcctcgccaatggaaatgggtgcgccattttcccacccaccggagcgcatttcccagtcatcgaccgggtgacctgcggtgaagagctgacagtttggcccgagcatgctgcgtgccccgatgcgaaccggtgcgatatctaaaatggtgaggccaaagttgatgaacacatgctcgccgatcgtggtgttgaagccgtattcaatgatggctggcgctttgatcgtgcaggttccgctggcaggatttagtacagttcttagtatttcggcagttcgtgcggggtctgtaggtccaatttggttgtattcgtggaaaagtaacgctgttttttgtgccacttcttcacgttccgcgccggtagccacgtaccaatcgccgctgctcattttctcgatagattcaaagtcattgtccatatcctccattgtgcaggagaactttagtgcctacgcttttcgacgatcccctccaccaacttcccagaccaccgcgcagggttgcagctggcgtggtgcacctgcccaacttcctcggcttggccgagcaaaaggcactggtcgcccaggctcgagaccttgcgcgtgaagttgtgggcacaccgttggcgatggtccgacccaagctgaaaagtggtcagatgagtgtccatatgttgcatttaggaaagtactgggcatccaatccttatcgctatgtggatgtcgttgatggttttccagtgccaccactgccggattctttcgtggacttggcacaccgagcattgctgtctgcaggatctttaagcaattcacttcagtcttggtcggaggcatatcgagcagaagcggcattggtgaattactactcgccagatgcttcaatgggcatgcaccaagacgctaatgaagaatcggaagcccctgtgatctccctatcgatcggtgataccggaatctttcgactgggcggcactctaaaccgcaataaaccgtggacagatatcccactaatgagtggtgatctcatcgttttcggaggtgcaaacaggcaagcatttcatggcattccctctattgaggccaatactgcacctgcaggatgcgggttgaaagaagggcgaatcaacatcacgatccgccaacttgcactataaaactccaggtagaggtatgtctcgggggtgaaatagccccgcaatgtcccatgctcaaattatggttcgcgccatgacaacaaacaaagctaatccaaatgaacttgtaatctgcgctgatgaaaagtcacggccccgctgggcatctagaagtgagctgtgttgggagtatttcgacaatgagtggggcagacctccggtggatctcaatgctctttttgagatcttgacgttggtagttttccaagtgggtgtcacctggcatgctgtgctgtccaaacgggaagggttccgtcaagcattcgcccaattcgatgttgcaaaagtagccgccttcaatgaggacgacgtggaacgcctacttgatgatctacagatttttagaaaccgaagaaaaatcaacgctgccatcaccaatgccaaagcgttgctggagttaaacgatgaaacaggcacctttgactcaattattgccgaccactcaactgacgccacagccatggtgaagcatctcaaagccttgggctttacccatatcggactgacctccttgagcatcctccagcaggccattggggtcacagagctgaaggctgcctaagatataactccgatgacaacagcacagtttctagcgctttttctggtgtggatcgcagcaattgcatcccctgggccagaccttttccagatcatcaggctaagtgccaaaaaccgccgtgatggcgtactgactgccgtaggcatcatggtgggaaactccatctggatcatagccagcctccttgggctctcggcactgatctccacgtatccagcaattttgaacctgttgcagctcgtcggtggcggttatttgacctggatgggcatcggggcggtgaggtcatggtggacgaaacgctccacacagcaagctgcagcggattctcaagctgtagagaatacgttggtgacagccacggctgcatctgtcggagtgtggccagctattcgatctggcattgctaccaacttgtccaaccccaaagctgtgctgttttttggttccgttttcgcccaatttgttagacctgacatgggaatcgggtggagtattttcattggagtcttcctcaccctcactggcctgctgtggtttgtggggttcgccgtcttggtccgcaaactagccgctggcctcacccgaaatggagccatcatcgacctgctaacgggggtgattttcatcgggctgggaatgttcatgatcttcgagggggttgtaggaatcggtggcagggtagtgggttagccccgcccccaggacgtcactagacttaggcactatgcaacctgaagaagtgcacatcaaggacgagaccatcaagttaggtcagttcatcaaattggccaaccttgtcgaatcaggcggagcggccaaagatgccatcgctaacggtgatgtcaccgtcaatggtgaagtggatacccgaaggggtaagacacttcgcgatggcgatgtggtgtgcatcggcgaggtatgcgcgcaggtgtctactggtgacgcagccgacgacgattattttgacgaagccaccgcaaacgatgacttcgatcccgaaaagtggaggaacatgtaatgccagcctttgaggcaatgccaggaatgccgtattggatcgacctgtccacctcggacattgcaaaatctgcacacttctacgaaaacgttctcggctgggaaattgaagaagtcaacgatggctaccgcatggctcgtctgcagggactacccgtggcagggctgatcgatcagcgcggtgaatcaagcatcccggatacctggattacctacttcctctcctacgatctggatgccactgcaaagaagatcgcagaactgggtggacgaattctggccgagccaactgacgtgcacttgggacgcatgatcctagctgttgatactgccggcgcactgttcggcgttattgagccaggcagcgaggaatcattcgtcgctgctggtgaaccaggcacatccgtgtggcatgaactcaccactgtctccaaatattccgaagctatcgatttctacggtgagctgttcacttggacaacctctgaaatggctagtgctgaagacgatagtttccgctacaccaccgcattggctgacggttccgcctttgctggaatttttgatgccaaaggccacttcccacctcaggttccaagcttctggcagtcctaccttggcgtgctcaacgccgatgatgctgcagcgaaggccaaggaatttggtggcgatgttattcgtaagccatgggactcagaatttggccgcatggttctcatctctgattccactggtgccacaattaccttgtgtgaagtagaggaatacgtcgaggaagcagcagaaggcgatgatctcttcgacatcgatctcagtgctttcgaagagcagttccgcaagcaagaaggacagtaatcctacagcgccatggaggaattagaatttgatgagctcacctccatggtgctcgactgcgcagacctcattccgcagggaaaagtagcaacctacggggacattgccaaaatagtaggaactggtccgcgtcaggtcggccggatcatggcgaccgctgggcaattcacatcttggtggagggtggttcgctctgatggtggctcccaggtagcgggcaccgcgcggtctaaatgggcagaggaaaatattgcgttttcagagctcagcgcaccaaaagtgagaatgcagcagcatcgtctttctgaagaagaactagaaactatcgcagggaagcttcaacaaatagctgactagccatcattggtagttcctaattgtttccgtacagtatagctccagcacaacttctgagtgcaagttttttataacagggcagtaacgtttactggtatgaaaactccccgtctgctgaagatcctcagcgcgatggtggctgtcactggacttctcattccaacggtggtccccatggccgccgctgatgctgctgaactgtccgacaacgttcccgatcgcacccaaattgccatcatcaaccctgatggcagcgtgcaagaatctgacaacgccgaagaatcccgcccggcattatccctggccaagctgtatttgggttattatgtgttggctcaaggcgcggaagaagatattgaactagtcccagatatgatccgctactctgatgatttcaccgcggattatttggagagcgaatacccggaagcaattcctgaggttattgatgccttcgatttggaagacaccgaatgggctggtttctggggcaatgcaactaccagtgcggtggatattgcgacgtttgtagcagcactcatcgacgatcccacggcgcagcccttgcttgacgcaatgtctgacaccgctgagtatgcggcggatggctacgcccagaactttggcacttttacattgtccgatgtcaccggtactaaatttggttggtctgattccctcgatgtgcattcatcggtcagctttggccctggttttgtgatcgctgccaacacctacggtgacgccgaaacgctcaccgaagatgtccaagattccgtgtcttcgctgtatccggaggaagtaaccaccgcgatcgaggagcaggtggatcagctgtgtgagtgcgctgcagagactacgcatttgggaatgcacactggcgcggagctgaaagcacagcttgagggcactatttatggaaaaaccctcagctttttacctaattcagccccagcgccagcgtttatttacaacctgctggcacattagcaaacagttttaaggaactccgccacgtcggtgattttttcgcgcgcgaccttcggtgtggaaatacggtggcgggaaacgtattccttcacggtcgcgtcgccaagctctcctggccgctccgcgatctcatcctgcgccgcgatctgcacaaaggtcgtcggccacgcagccgccgcgggcactacagcgtctccacgaatttcggcagggagcttctcgacgctacccaggtccggaaaggtgaggaccagggcgtcgaaaagcgatgcattaatcgcggctaacgccgcgcccgaggaataaccccaacccgtgatcgacaccggattatggtggcgggcgtaaccgaccgccttgcccacaacctcattcatatcgtggaggttatggcctggggccagcggatagtccaggtcaaggatggttgtgccggacaattccgcagctgccgcgacctctggacgccactggaactccaacgcatcaccggaaccgcgccaccaaccaccgctgtggaacgatacagcccagcggcccgtcggattcgacgggtggaaaatcgcgcctccgacctccgggacgtcatcgacgctcacaccaccgataaatgcgacacccggcatggaatgatcaaggccagaacccaacatgatcatcgcagtatgcgtggtgcgatcgggaagatgtgcaatatagcggtctgctggatcaggatcgccggcgccacctgcccaagggggcgtgaaatctggaacagggtagtgcgcatcaatatacgatccgagctgctccagctgttcttcttcagaaagctgacgatccttaccgccaacctcgaactcctcacggaagcgtgcttcctgatcttgttcagtttcttgtggggtgttgttttcagccatgggcacaaccttagtgcgtgcgctcacgtcgctggttggaaagtgaaaatatcaacagtgttttgggtgggggtgagattggaatgatttcggcccgggcgctcgaaaaccgtgatagacacaatgaaccgagcaaatccgccaggaaataaattaagtaaggaatatccatgagtgaaacccagtcgaattcagtgtcagcggtaatgcctgcgcagctccctccagggcctgccgagcgtactgtgtactcctacggtgttcgcgcaggggatcagttgcacatttcaggaatggtggcttttgattctgacgcgaatattgtcggcgaaggggacattgaggcgcaggctgaacaagtctttaagaacctgcaagcagtagtcgaggaggcaggaggaacgatcaacaacattgtttccaccactacttatcttgccgatgtcaccgatgctcccgttgttaacgctgctcgctcccgctatttcaccggagaagtattgcccacccacaccgtaattggagttgctgctcttgctcggccacagtttctagtcgagatctcagcggtggcctatttgggggacctttcaaaagactagatacatgattatttttgcattaaccccaggtaggggcattgtcgcaaagcccaactacagcaaggtgcgtacgctggtggccaactgaatacgtttgaggagaaggttttctatgagtggcaccgccatcatgtacgacacgacagttgttccatcgaagaaagaaatcgcgcaggcttggactggttatgtggatcttcagggaagctaccgcctggtagatacggtggatggggaagttggcgttgaggtgctgatttccaaggatcgggaggggcgtttactccagattccgtttagttatcgttcggcagagattaacccagagcagacactttccacattggagcatggtgtgttgggcaagcgttgggtgactaatgcgttgggtgacccggtggcagtgcgggagtttattcgcactattttgacgggcgatgatggtgcagctcgtagcgatggcgtgaagggctatctggatattaaaggttccggcgatgctgagtcggtggatttacaggatgtaaagcttactgaggttacaaggcagcgtgcgattggttcggtaaccatcaacggtgagcgaaagcaattctcgctgcggttgcctcagttgctgaagaatttcagggagacagcggcgggccatacagctacgactcttcgtattgtggcgactcatccggaaaaggacgatgttgagctgctggtcgctgagttcaactggatggaataatccgagacagctcctgaaagctaaaaagccctcgccccgaaatccatcggcgcgagggcttttcaataccaactaacaactaccagatagctaggcgctcttctggcttgatgtacacaggtgcatcttcggggacgtcgaatgcttcgtagaattcagcgacgtttccggcgatgacattgcagcggaattctgcaggggagtgtgggtcgatggccaggtattggacggccatctgtgggcggattttggtgcgccacacgcgagcccaggacaggaagaggcgttggagaccgttgaattcttgctcggccaggccttcctcggcgccttctgcttcgaatttttggactggtgaggtttcaaaggtttggccacggtctgcgaggtacttttcgtaggcaacgacagcgatgcccaatccgccgaggtcaccgatgttttcgccgagagtgaattcaccgttgacgccgtcggtgtcgattccttcagaggtcaggacggcagggacgagtccgctgaattgggtgaccagacgtgaggtgagctgctcgaatgcggagcggtcttcgtcggtccaccaggagttgaggttgccgtcgccgtcgtattggctgccttgatcgtcaaagccgtggccgatttcgtgtccgatcacagcaccgattgcaccgaagttttctgcggcttctgcttcggggtcgaagaatggtgcgcgcaggatggctgcggggaaggtgatgtcgttgaccacggggttgtagaaggcgttgacggtttgtggggtggtgacccattcgtcgcggtcggctggtttgccgatcttgcccagctcatagtcatggaggaacgcggagcccttgcgggagttgtccaccaggtcggagccgaattcgaggccttcgtaggagcgccacttgtcggggtagccgattttcgcgttgaatttgcccaacttttccagggcacgctcgcgggtggcgggcgtcatccattcgaggttggaaatgcgatcacggtaggcggcaaccaggtagtcgacgagctcaagcatgtgctccttggagcttgcaggaaaatgcctttcgacgaatcgttgcccgatttcctcgcccaccatgcgctctgccaggccgacagcacgcttccatcgatctttttgctcggtggcgccggacagtttggtgccatagaagtcgaagtttgcttggctaatttcctcggtcaacagtcctgctcgagacctcaagatgtgccaggttgcccatagctgccaatcggggaggcggtcgtcgacaagcaagccgttgaggtggtcgaggtatgacggcatcatcgataccaggcgctggtccgggaggcctgcggaactgagcagcgtgcggacctttggtggcagcgcgccgagttcggtggggttgtaggtggctacggcgtcgcgggtcttcacgacatcccagtggccagcagcgatttccgtttccagggcgacaattcgtgcggcagcggaagcagccgacagaccgaagaggcggctgttatccaagtagccgagcatgcgctcaacgtgctctttgtaggccgcgagagtttcggcgtgtgcctcctcgcggtaataagcctcatcgggcaggccgaggccggactggatgacataggcgacggattcgttggaggaagaatccttctccacccagaaacctactggcgcgccaacgccttcacggtccagttcgccgagagcagctgcgaaaaacgatgagttagcaacagacagcctgttcagatccgcatcgagcggtgcaacaccagcagcgttgatggcgtcagtatccataaatgaggcataaagtgtgcctgcgcgtccagtgtcttccttgacgatctcatggacgtcttcttcagcatcatcgcgcagcttgtggaacgtgccgtccaccgcgcgatcgtcgggaatgatgtgggtgtcaagccacaggccattgacaaagcgataaagatccttcatgtggcctactctaggggatttaccgccacagggtttgtggttggtgccacaagtgggttgagcgttggggatcatgtccaccccagaaggtagcctgtcagtgtgagcgtaatcgagggcaagtaccagctgaaacctcaaggccgaggtggcctgtggtggtcaatcgtgggtgtggcagttgttttgttgctgcttccaacgttgatcaacctggtggttccggataaagccaatgactacaagcagctagaaatcgatcttctgggtgtggattggtcagtgccaatcaccacggaggaatccgctgcggtgctgtgtgaggaaacatctgatgaaatcacacagaagtattgggactgcaacggggacaccacggtggtgaccatgatcgtcgagggcgtgaaagatccgtccaatacgttgcgtcgcatggtgggttcatcgctgataaccagtgtggatgacagcctagaggcagtatctagcgaagatggccgtgcgcatgcgttgtatgtgccaggtcagcaagaaggatctttgtggacgctgcctatcgtggcactgagcgtgcagggttcgggtgattatgaagacctcacagcgatcgcaattatcaacggcacctcgttggattattacagcacccacatttggtccagcatggccgctgaccgcgggttgccgtaccagcaggacttccccctgatgctggaagaggagccatggcaagacacccccggcggggatcgtcccttcgagctgcccaatgatttctttgatcagtaccccgatctttttggcccaggctccgtcattcccaaccttgaaggagaatccctatgagtcgcatgtttagcatcaccttgtgggttgccatcctcctctcaaccccggcgctgtttttgagcttggccacgttcatcttcgtggatggcatctctgtcctcgtgaatatagtgttcgcggtgctctacttggtagtcattgttttcctgttaagtcgcaccccgctgtggccacgttttaaaggctccggcagcaagaagggaggcggattcgcgtgggcggcgtcatcattgttgtggggcgcgttcgttggtttcggcatcgtcatgttgtttgccggtccggtcatggatctcacggacaaactcggctgggatttcgttgccatgagtttcaccggagcgtatccagaagaaatcgccaaagcgttaggcgttgccatcatcttgttgagcttccgccaactcaaccgtccgtggcatggatttatcaccggcgcgctagtgggcttaggttttgaggtcaacgaaaacctcctctatggcgccaccggtgcaatcatggaccccaacgctgacctcgacggcgtccttatgatgtggcaataccgcaccatgttgggcccactcatccatacgttgctcaccggattcgcaggttacggcatcgcgttggcattcttccgcgcacgaaaaacagtcgcctggcgctggggcgtggcgatcggttggactctcatcgccttcgcactgcatttttcatggaacctgatgtgggaaaacgtaatcggttcctatgtcaccatcatcgtggtcagcgttgtcatgtacggtctggctatctacatcctctggagtaattgggccgaagcccgcaacgactccagctacgctttcgtcccgggaatcatcacaaacaccaaagatttatcgcttcttgacgcccccattccagtaggcgctgaggttcccgagtcgcgcattccccaacagatagaggaacccaaggcggagaactagctttcactcgctctccatccgctggaccaaaccaggtgaccgaagatcccattttcttaagtgggtcggtcacctggtttggttttacagtctagaaaccagcccatgtgaccgaaaatccaaagaaccccactccgttggccgtatggtctggtcggggcaccttcacgtaaaaaacttgcactcaaaccctgggaactcgacctcacagaatcgcttctaagggcctttcagggtgtcatcgataccaatgctcgtttgagaaactcgacgccttggagcgctgctgcatatccagaccaaagaccctgaaattcagcatccgtttggtctgatagagcagttttccagccttgaaaatgccatatcagaccaagagctccagttcagaagggctctttggtttatttcttacctggccaccagagtggtttcaaagttgtacatatctgggcggtagcagtggcttcccaactcgattacttggccggaattatccaatgcaacgcgttcgacggtgagaagtggtccgccgtcttcgatgtcgaggagggtgctttcttcaccgactgctcggcgcgcaccgattttctggttggcgatttttaagacaacacctcggctgcgcagcgcatcgtagagtccacccttttctagttcgtcgagggagacgtcgttgaacgctggggggaggtagttttccaggatcgctacggggatgtctccggtggagcggaggcggcggatgaggaggacttcgtcacctgcggaaactccgagtttttctgcgatggcggaacttgctgcaaggaggcggtgctcgaggactcgggttttggggtccaggttggcgtttttgaggtcgttgaagaaactggtcagttcgactgggcgggtgacgtggctttggacgacctgggtgccaacaccgcggcggcgaactaagaggcctttgtctacgacttcttggatggcgcgtcggacggtggggcgggatacgttgaggtgtttcgccacggagatctcgttttctaggcgtgctccgggtgggaggactccgctgcggatgccgtcttcgaggcgttgggctacttggaagtagagggggattggtccgttgcggtcgaggtcttcgaagagttcggctggccaaatgggagcttcggtggtcatgatgtctcctttcgttgcccacccaacaagctcatgtaaatgtgttaggacatttgaacaatgtaactgagttgcgggtggtggtcttggtaaatccgtgttcatgcaggacttttgtgtcatccagggcttttattgatctgacattatcacttgcattagggaatgagtagcgaaacttagtgaaaagggcagagtttgcaggtcataacgtgcaactttgttaaccccgcaccttccaaagcgagggggttttcgtcgacaagcaaaatctttgaatgaaaaccggggcgttgccctggggttttgcgcgttttcgggaatcgttttagaaaattttcggaaatgtattgctttgtcaggacaatgtgttattgtcatgacatgcgatcgtgagggtcgccacattccatcaaaaatgagtgaagggttgcatcgccacatgactaacttgacgagcactcacgaagtcctagctatcggccgcttgggcgtagatatttacccacttcaaagtggagtaggactggccgatgttcaatctttcggcaagtacctcggcggaagcgcagcaaacgtttctgttgcagccgcccgccatggacacaattccgcactgctgtcccgtgtgggaaatgatcctttcggcgagtacctgcttgctgagctggagcgtttgggcgtggacaaccagtacgttgccaccgatcagacttttaagaccccagtgaccttctgtgaaattttcccaccggatgatttcccactgtacttctaccgcgaaccaaaggctccggatctcaatattgaatccgcagacgtcagcctggacgatgtgcgcgaagccgatattttgtggttcacactcactggtttcagtgaagagccaagccgcggcacacaccgcgagatcttgactactcgtgcgaaccgtcgccacaccatctttgatctggactaccgaccaatgttctgggaatccccagaagaggccaccaagcaggcggaatgggcgttgcagcattccacggtggcggttggcaacaaggaagaatgcgaaatcgcagtgggcgagaccgagccagagcgcgcgggccgagcactgttggaacgcggtgtggagttggccatcgtcaagcagggacctaagggtgtcatggcgatgaccaaggacgaaaccgtagaagttcctccgttcttcgtcgatgtcatcaacggtcttggtgccggcgatgcattcggcggcgcgctgtgccacggtctgctctctgaatggccgttggaaaaggttctccgttttgccaacaccgcgggtgcgcttgtggcgtcccgtcttgaatgctccaccgcaatgcctactaccgatgaggtggaagcctccctcaaccagaaagtctgatatgactcctccgattatctccccagagagctttgaagccctaaggcggatgcgtgcggctgaacccacgatggtggcggaacgtttcaagcagcgccgtaagcgtgaactgctcggtgaggacggcaagctgtttatcgtggctgccgaccacccagcgcgcggcgcacttgctgttggcgacaatgaaaccgccatggctaaccgctatgaactgctcgaacgcatggctatcgcactgtctcgcccgggtgtggatggtgtgctgggaactccagacatcattgatgatctggcggcgctcggactgctcgatgacaagatcgtggttggctccatgaaccgtggtggcctgcgtggcgcttcctttgaaatggatgatcgctacaccggctacaacgtgtcctccatggttgatcgtggcgtggatttcgcgaaaaccctagtgcgcatcaacttgagcgacgccggaaccgccccgaccttggaagccaccgcgcatgcagtcaatgaggctgcagcagcacagctgcccatcatgctcgagccgttcatgagtaactgggtaaacggcaaggtggtcaatgatctttccaccgatgcagttatccaatctgtcgccattgctgctggtctgggcaatgattcttcctatacctggatgaagcttccagtggtggaggagatggagcgcgtcatggaatccaccaccatgccaaccctgttgttgggcggcgaaggcggcaacgatccagatgccaccttcgcatcctgggagcatgcactcaccctgccgggtgtgcgtggcctgaccgtgggacgcactctgctgtatccgcaagacggcgatgtcgccgccgctgttgataccgcagcgcgacttgttcacacagatattcaacaattcacttcgcagagcatttaaggaatttacacacatgtctgaaccacaaaccatctcgcactggattgacggcgcgatttccccatccacttccggcaagaccgctcctgtctacaatcctgcaactggccaggtcaccgccaatgttgcgctggctagccaggaagagatcgatgccaccatcgcttctgccaccaaggctgctaagacgtggggcaacctgtctatcgctaagcgccaagctgtgcttttcaacttccgtgagctgctgaatgctcgcaagggtgagctggcggagatcatcactgcagagcacggcaaggtcttgtccgatgccatgggtgaaatcctgcgcggccaggaagtcgtggagcttgctaccggtttcccacacctgcttaaaggtgcgttcaacgagaacgtctccaccggcattgatgtgtattccttgaagcagccactgggtgttgtcggtatcatcagcccgttcaacttccctgcgatggtgccgatgtggtttttcccaatcgcaatcgctgcaggcaacgcagttattttgaagccttcagagaaggatccttcggcagcgctgtggatggctcagatctggaaggaagctggtcttccagacggcgtattcaacgtgctccagggcgacaagctggctgttgatggtttgctgaacagccctgatgtctctgcgatttccttcgtgggttccaccccaatcgcaaagtacatctacgagacttccgcgaagaacggcaagcgcgtccaggcgttgggcggcgcgaagaaccacatgctggtgctgccagatgctgatctggatctggttgccgatcaggcaatcaacgcaggttacggcgctgccggtgagcgttgcatggctgtttctgtggtcttggctattgaatctgttgccgacgagctcattgagaagatcaaggagcgcatcgacaccctgcgcatcggcaacggtgccggcgacgagcagggcgagccgcacctgggcccactaatcaccgacgtccaccgcgacaaggtcgcttcttatgtcgacatcgctgaggccgacggcgccaagatcatcgtggacgggcgtaactgcgccgtagacgggcacgaggagggcttcttcttcggccctacgcttatcgacgacatcccactcacgtcccgcgcctacaccgaagaaatcttcggcccggtcctctctgtcgttcgtgtcgcatccttcgacgaggcaattgagctgatcaactccggtgaattcggcaacggaaccgcaatcttcaccaacgatggtggagcggcacgccgcttccagcatgagatcgaagtgggcatgatcggcatcaacgtaccaatcccagtgcctgttgcgtaccactccttcggtggttggaagaactccctcttcggtgacgccaaggcatatggcactcaaggttttgatttcttcaccagggaaaaggcgatcaccagccgttggctcgacccagcaacccacggtggcattaacctcggtttcccacagaacgattaattgaaggagagcacaggactatgcgttggttccataagaagggcgaactggcccgagatggttggcaaagcgttgtcgatgccaccaccccaggttgggaatataccggcatccgcattgccgaactgggcagtggtgaatcgcttgaactgaatgacactggtgtggaacgcatcttcattccacttcagggcagcttcgatgttgcccaccatggtcaggtgacccatcttcacggaagaaagtcagtctttgatggaccaaccgatgtgctctacctccccactggacaaacagcaacgctcagtggtcagggacgagtcgccgtggcggaagctcccactcaggaacccaaggagtggaagtacatcgctccagcagaaactcctgtggagttgcgtggagctggccgctcgagccgacaagtccacaactttggcaccccggaagctctcgatgctgctcgactaatcgtgtgtgaagtaatcaccccaggtgaaaactggagctcttaccctccacacaagcatgatgagcacatcccaggacacgagtccaagctggaggaaatctactacttcgaaagcgccccatcgcgagttggtggcagggccgaagcagcagaaggagctttcggaatgttttccacctactcctcaccagcgggggagatcgatatcaacgccatggtgtacagcggcgatatcgcgctagttcctttcggataccacggccctgccgtggcagcacctggctatgacttgtactacctcaacgtcatggcaggacctgatccggagagaatctggctgattaacgatgacccagcgcacgcctgggttcgagatacatggaccgggcaagcatttgatgatcgcttgccatatgagaacgcaaacaaggagggataaaatttcatggctgaaacgaagagaatgacagttagccaggcactggttgaattccttggtcaccagtggactgtcgacggcgatatccgcgagcgcaccattccaggcatgttcggaattttcggacacggaaacgttgctggcattggccaggcactcaagcagtacaacgttgaacaacctgagctcatgccgtactaccaggctcgtaatgagcaggcgatggtgcaccagtctgttggatatgcacgcatgcaccgccgtcgtggcacatacgcatctgccgcatctgttggacccggcgcgaccaacctgttaaccggtgcggctcttgctaccaccaaccgtttgccagcgttgctgctgcctagtgatacttttgccacccgcgtggcggatccagtgttgcagcagttggagcagccatgggatatcgggctgacggttaatgatgctttccgccctgtgtctaagttctttgatcgggtgcagcgcccggagcagttgttctctattgcgttggctgcgatgcgtgtgttgactgatcccgcagaaaccggtgcggtcaccattgcgcttccagaagatgtgcaggctgaaatgctcgatgtgccggtggagttcttgcaggatcgtgagtggcacattaggcgcccacgtccagagcgtgctgcgttggctcgtgcgattgaagtcatcaaaaacgctaagaatccgatgatcattgctggtggcggagtgttgtactccgatgcggaaacgcagctgcaggcacttgtggagcagactggcattccagtgggtacctcccaagctggtggtggcgtgttggcgtgggatcatgcacaaaacttaggtggtgtgggtgccaccggaacgttggctgccaaccgcattgcgggtgatgctgatgtgatcatcggtatcggtactcgttacagcgatttcaccaccgcatctcgcactgcgttccaaaaccctgatgtcaccttcatcaacatcaatgttgcttccttcgatgcttacaagcatggcactcagttgcctgtgattgcagatgcacgcgaggcaattgtggagcttgctgaagccctgcagggattcaccgtggcagaggattacgcgcagcgcatcgcgaaggaaaaggctgcgtgggacgcagaagtagataagtcttttgccccctccggtcttgcgctgcctggacagccggagatcatcggcgcggtgcaggcgtcgacaagcgaaaaagacgtcattgtgcaggccgctggatccttgcctggtgacctgcacaagctgtggcgtgtgcgcgatgcgctgggctaccacgtggaatatgcgttctcgtgcatgggctatgaaatcgcgggcggtatcggcgcgaagcgtggacttgatgccgcaggcgatgaccgcgacgtggtgatcatggttggtgatgggtcctacctcatgctcaacactgagctggtcacggccgtggcagaaggtatcaaggtgattgtggtgctcatccaaaaccacggttatgcctccatcggccacctgtctgaaactgtcggttcgcagcgttttggtacttggtaccgcgaatatgacgctgaggcgaaaaacttccagggcgagcagattctgcctgttgacctggcgatgaatgcacgcagctacggcatggatgtcattgaagtggaaccaagcgcgaatgcgatcgaggatctcaaagcagcgatggcaaccgcgaaggcttcggagaaatccaccttcatccacatcaacagcgatccgttgatctacgcaccagacggtgctggttggtgggacgtgccggtgtcggagacgtccactctggatagcaccaacgcggctcgtgaagattacctgaaaaaccaagccctccagcgtccgctgctcggctaaaccagttggctaaaccaaaacgtatttaaggagaaacaccatgaccacttctgtacctgcatccaccaaagcttcatctgtggctggcgaaaacccaggcctgcgcatcggcaccgcacctgactcgtggggcgtgtggttcccagaggatccaaagcagatcccttgggagcgtttcctcgacgaggtcgtcaaagctggctacacctggatcgagcttggcccatacggctacctgccaaccgatgccaaccagcttgaagatgaactgggcaagcgcggcctgaagctgtccgctggcaccgtgttcaccggattccacaagggtgaagagcagtggaagcgcgcctgggatcaggctctcgacgttgctggtcttgcttccaagctgggtgctgagcacctcgttgttatccctgacctgtggcgctccgacgcaaccagcgaagtactggaagctcgcacccttgatgatgagaagtgggcaaagcttgccgccggtcacgaccgcctgggcaaggcgctgctggaagagttcggcatgaagcagcagttccactcccacgctgacagccacatcggcaccacccgcgaagtactgcgtttcctggaagaaaccgatgcgcgctacaccaacctctgcctcgacaccggccacttcgcctactacggcggcgacaacgtcaagctcattgagcagcacccagagcgcatcggttacctgcacctcaagcaggtcgatccgactttgcttttcgacgtactaaagaacgacaccccatttgccgaagccgtagcccaaggcatcatgatcgaaccaccacacggcatcccagacttggccccaatcatcgaagctgtctccaagatcgactccgagatcttcgccatcgtggaacaagacatgtacggctgcgacatcgattacccattcccaatcgctgagcgcacccgcaagcacatcttcggctgcacccacttcgcacgcgtcaactaaccacttaaatcatctcaaggagtacaaaaattatgagcaagagccttcgcgttggagttgtcggtgcaggagccatgggtgctgaccacatcgatcgcatcaacaaccgcacctctggtgcacacatctctgccattattgagcccgacgcagcacgtgccgctgcagctgcagaagacgcgccgggtgcacaggccttcactcgcattgaagatgctatcgcagccgatgctgtcgacgcagtgctgatcgccgtaccaggtcagttccatgagccagtacttgtcccagcactagaagcaggccttcccatcctgtgtgaaaagccactgaccccagattctgaatcctcactgcgcatcgtcgagctggagcagaagctggacaagccacacatccaggttggtttcatgcgccgcttcgaccctgagtacaacaacttgcgcaaattggtggaatccggcgaagctggcgaactgctcatgctccgcggcctgcaccgcaacccaagtgttggtgagagctacacccagtccatgctgatcaccgactccgtcgtccacgaattcgatgtcatcccatggctcgcaggctcccgagttgtctccgttgaagtgaagtacccaaagacctcctcactggcgcactccggcctcaaggaaccaatcctggtgatcatggagctcgaaaacggcgtgcttgtcgacgtagagatgaacgtaaacattcaattcggataccaggtagcaaccgaagcggtctttgaaaagggacttgcccgcatcggccagccatccggaatgcagcgctggcgcgacggtgaattcctgatcaacgaacacaccgatttcaccacccgtttcgctaccgcctacgaccgccagatccagagctgggtcgacgcagtccacgaaggcaccctggtcgcaggccctaacgcatgggatggttacctggttgcactgtcatgcgaagctggtgtcaaggcactcgacggcggcgtcatcccagttgatgcggcacctcgcccagatttctacgcttaaggagttttgaacgtggttcgtattgctcttgatcccacccccttccaccatgattacgatctgttggatttccccgacgtcaccgcacgtttggggtatgaatacatgcagctgacccctcatgtagatttcggtcctttcttccgccaccccaaggcagacgatgatctcgtggcagccctgaaaaagcgtgccaaggatgccggagtcaccattcctgcactgttgccagtgcagcgtatttcctggccggaggaaacccagcgtgttgcagcagtacgcaacatcaagcgcatcatccagttggccgttgatctggaagtagacaccctcaacacggagttttctggacgcccagaacgctccgaggattccgaagatgccttctaccgctccatggaagaactcctgccaatcctggaaaaagagggcatcaagttcaacatcgacccacaccctgatgatttcgtggaaaacggtattgaagcatggcgagtcatccgcggtctgaactccaagcaggtgggctttgtttacgtggcacctcactcattccacatgggtgatcaggctgaggcaatcctgccagcagtaggcgatcgccttggggctgtgtacctgtcagataccttcgaccaccacaaatcccacggcctgcgctacatcactaaccctccaggcaacgcagtgcgcgtgcaccagcacctaaaaatcggtgatggcgatgtgaactttgaagagatcttctcactgctgcgctctaccggttaccttgaccgtgaagatgcactgttggtctccaacgtgtttgcagaagatgaagcagcagatgaagtatcccgctaccagctggagaaaatccgctcactcatcgaaaacgcatagagttatctcgaaactaccaagacggtttcttttctttagatctaaggaggagagaccgtctttcaccctttcatctgattggacatcgacgccatgcgcaatgatcggtcctttagcgttcccattgcgctacttgccgcgggagcactgtttctagaaatcctcgacggcaccatcctgacaaccgcagtgccagctattgctcgtgacttcggtattgacgccgtggatgtcagcattgcactggttgcttacttggcagccgcagcagctggcattccggctgcagggtggctagcggatcgatttggtgtgcgcaaagtcctgttgctggctttagcggtgtttactgcagcctccttggtttgtgcagtggcgccggggctgactgtgcttaccggtgctcgcgttatccaaggtcttggtggtgcactactcgtcccagtcgggcgattagcagtaatccggggaacggatcccaaagatctccttgatgccatcgcgtttttaacctggccagctctggttgccccagtgatcgccccacttctgggaggtcttcttgccgataccattggttggcgatggatcttcctcctcaacgtgcccttaggaatcatcgcgatcattgctggactattcatcctgcccaagaacactgccgtgaatgtgaaacgatttgatcttccaggtttcctcggcgcaatgctggtgatggtggcgctgaccgtggctgcggagttaatttccaggggaagttcggctgaacttactatcgctgcatgcctcgtcttaagtgctgcggtggtatgcggttttgtagtgcgctggctgcgagttccaggccgactttttgatctcagcatcatgcgcatcccaggtttccgagtgggtaattcctccggaagtatctaccgcttggtaatcaccgcagcaccattcatgttcactttgctcttccaagtggcgtttgggtggtctgcaacattagcgggtgccatggtggtcgcactattcgcaggcaacgtggcaatcaaacctttcaccacgccgatcattaaacgctggaatttcaaaccagtactggtcttttctaacgctgctggcgccttggtattggcaacttttttgttcgttcgtgcagataccccactggttctcatcgtgctgctgctctttgtttcgggcgcattaaggtccctcggtttcagcgcctacaacaccttgcagtttgtcgatatctcaccagaacaaaccagcaacgccaacgtgttatcagcaaccctgcaccaactaggcatgtctttgggtattgcggtagcagtcatcgccatgtcccttgcacccaccgccaactgggcattcccactggcagcagcgttgttcctcattcctctaatcggcgcactatctttgcctcgcgacggcggtgcccgagccttttcctcctcttagaaacccacttctgaaaggtataaaaacatgactattcgaatcggactcgttggctacggtgtcggcggcaggctctttcacaccccttacatccaagcttctacgcactgcgaattagtaggcgtagttgctcgttccgaaggcaccaaagcagccgttgcagaagatcttccagatgttgccatcgtgggatcgctgacagaactcctcgaactgggcgtcgatgcagtggtgatctccacccctccagccacgcgccgggaactggccttggaagcaatcaacgcaggtgtcgcagtggttgccgataaaccgtttgcaccatcagccgcagatgccatggaacttgtcgaagccgccgaaaaggctggagtgctgctcaacgtcttccacaacaggcgcaacgacacccacattgtcacggcactgggaatccaagaagaacttggtgcgatgcgtggactggacctgcgactagacctgatcgaacctgattccttggaggcaggtcctgaaggtggtttgctgcgcgatctgggctcacacgtagtcgatcagaccctggttctcatggggccggctacctctgtcaccgcccaacttggatccatcgaccttccagaaggcccaaccaacgcaaggttccgcatcgtgttggaacatgaatcgggcgccgtatcgcacatttctgccagcaagattgaccgcttggagtcctgggaaatccgcttggtgggcgagcgcggctcctacgtatccaactacaccgacgtgcagaccgtggcgatcaaacagggacttcgaccaaccaatgaccgcgaacactggggctacgaatcggaggagcggtggggcaccttggttaccgatgaaggctcaaaggtgattccttcagcacaaggcgattacacccgcttctacgatgcctttgccttggctgtggaaaacggtggcgcagggccggtgcctgcacgtgaaggtgttgcagtgctcaaggtgttggatgctgtagcccagagcgctgcggaaaaacgcaccattgagttgagctaaggagaagtgctgctggctgctagcggtaattagacgtctgtctctagggatgccgcatcccgccggcgctcctagagtccgtttgtaaaacctagaattccgaatacgttccgaatagggtgggggtatgagtaagatagttgatctgcgctatgggacccggcgttcctcggagttgagcaaacgctctgctgaagtctttgccgaagctgaagaacatcccattactgtgacacgtcgtgatggtgaagcgttggtattgatgtcgcagcgcgaagctgacgggcgagcccgcctgctggagttggctgcacagttaattactgtggccactgatcatcagggcacgttagccgaacgtatggcgaaagtattcccgtggatgctggccctgtcagtggcggatcgtgaggcgtgtgcccgtgagattcttgacgctgcacgagcatcgtttgcaaccgaacaacctcacctcgctcttactgaactgacctcatggaaagaaacagcagcagctgttgctgctggattgagtaacactgatctgcagtggtacgacgatccgcatctggtggagcgtccctaagcgtggctggaaagaaaagcgagttagttcctcgcccgcgcaagaaaaacgaattcgaaagccgctttgctaccactcacgcagcaaaagggtggcgagatttagtggcaagcatccgtaaccccatggcagagacgtgggattttttgaccgtgacgccgctgttgaccacgccgacgaactaccgacttaaaggtgaattgggtatcgttcaccataatgggaaggcgcatgatcggtggcaacataaatctactgcgaaagggtctgctcgaatctggttttatgttgagaagaacactgtgttcctcgagcaggtccatacccatcatcctaatgagacgaagtaatccctcattaggaagtccaagtatttggggtagctatccacgtggcgcgcacgtgccccgttcaatcagcgagggctgcaacgtatgcatgatctccgggtggggtgcctcgggatcaagcatgctcagcaacaagagagcggcgttgtagccgacgccgatgctgttgtcgtcgatggtggtgaggttgatcagtcgggtttgggcgaggggagtgttgtcatatccgattattgatagatcttcaggtacgcgtaaacctagttcacgggcggcaccgagtgctccgatggcggtgatgtcgtttgaggagaaaatggcggtgacctccgggtgctctttgagtagtgcgagggtttcggtgtacccggcgtgctcaacggcggggccgaggtaatcgttggaaagcggctccaggccatgtgcacgcatggttgcctcaaagctttcgaagcgtcgtaagccagcgccgcttcccacgcgtaggtgggcgatgtgggtgtgtccaagatcgatgaggtgttttgtggctatttctgcgccccggaagtcatcgttggccactgaatcatgggtgctggcttgggtgattctggtgcctgcgatgacaaatgggggtagggaatcggggacagtgaaatcggggatgtcttgggcgatgatgattccatcggggcgcattgatagtgcactggtaatgggatcggtgccggcttgagaggttaatgagtcaatgacggacagtcggtaccccttgggggtgagcacatcgctgaggctttgaatcaggtcgatgaaccacgggttggagtagtcgtcgataagcactgcaatgagctgcgtgcgcttggccgcaaggtctgatgcggcgcgatttggctggtagttgagcttttttatcgcggtcttgaccgcggcttcggattctttgctcacgttgggggagccgcgaagcacgagagaaaccaaggatttggagacgcctgcggctttggcgacgtcataaattgtggggcgggatgtgctcatcttctgtgattttctcttgaactattgacaggacatttaaacaaatatagcttgtgttggagcgctccaattgcgtagtggatcacaataccggatccacatggtctaacaacacatcatctttttcgaggaggtcatagtgactcagcaagaacttcgcgtagctgtcattggtgcaggcatggcaggcaaagcacacgcagcgggctaccgcaccgcatccagcatctactccaccactctgcccaacatccgtttggtttccatcgcggatgccaacgtgcagctagctgaagaaaccgcagcacgctttggctttgagcgctttgatacctcttggcaggcgatcgttgaggccgatgacatcgatgttgtcagcgtcgtggtggctaacttcctgcaccgcgaaatcgtggaagcacttctggcatccggcaagcatgtgctgtgcgagaagccactgtcagacaccatcgaagatgcagaagccatgattgaggcagccggccgtgcagcaacaaatggcaccatcgcccgcatcggactgacctaccgccgttccccaggcgtggcacacatccgtgatctcgtgcagtccggcgagcttggcaaggttctacacgtcaccggccactactggaccgactacggatccaatgcacaggcaccaatcagctggcgttacaaggggccaaacggctccggcgcactggcagatgtgggaagccacctcacctacctggcagaattcgttgcaggatctgacttcgccgccgtccgtggtggccagttgtccaccgtgatcaccgagcgccccaagccactcggcgcgattgtcggccacgaaggcggcgcagtttccgatgaatacgaagcagtggaaaatgatgacattgcatcattctccggatccttcatcggtggcggaaccgcaaccctccaggtcagccgcatttcccagggacacccaaacaccctaggttttgaagtgttctgtgaaaagggctccgtgctctttgatttccgcaactcaggcgaattcaaaatcttcaccccagcaacctccggtgacatcagccaagaagccggctaccgcaccatcaccatcggaccaaagcacccatactggcgcggcggccttgcaatggatgcaccaggcgtgggaattggccaaaacgaaggcttcgttttccaggcgcgcgcattcctcgaagaaatcgcaggaatctccgaagctgaaagcctgccacgctgcgcaactttggaagaagggctacacaatatgcagctcattgatgctgtatcacagtcagctgcagcaggtggcgaaaccgttgcggtcccagcggctgctctgatccctgcaaacaactagaaactattcagaaagcatcaccatgaaactcggtctctacaacgcgatcttccacgaccgcaccctgccagaagcgctcgcagccatcaaagctgcaggtctcaccggaattgaactcaacaccggcggatttttgcctgcaacccacatcccgaccatcgatgacatcctggtcagcgatgatgcccgcgatgaattcctcgggattttcgaaggcaccggcgtcgacatctacggccttaactgcaacggcaacccgcttcaccccaacaaggcgatcggggacaagcatgccgaagacattcgacgttccatccgcctcgcagagcgcctcggccaaaaccgtgtggtcaccatgtctggtcttcctggtggcgaaccaggcgcgaagtacaccaactgggttgtcaacgcgtggaactccgcagccttggatgtccttgattaccaatgggatatcgcagctgaattctggcgcgagaccgaccgcttcgccgcagatcacggcgtgaaagtggctcttgagctgcacccacagaacatcgtgttcaactccgctgacgtgcataagctcatcgatctcaccggcgccacccacgtgggcgtcgaactggatgcatcacacctgttctggcagcagatggacccaatcgctgtgattgatcacctcggcgagctcatcttccacgccgccgccaaagacgtgcgagttaataaggaatgggctcagctcaacggtgtgctggacaacagcttccgacgccttgacccatccgaaaaccgcaccaacttgggcggcgacgagtgggcgaatgaatggccaaagaactctgcttgggatttcgttgctctgggccgcggtcatgacgttgcttactggaccgaattcctccgcgcacttcaccgcgtcgatccaaacatgctggtcaacatcgaacacgaggatgtttcactcggtcgcgaagaaggcgtcaacgaagccgctaaggtgctgatcgaggccaacaaggcactcgaagagtccctggtttcttaaaaaaactacgcctgccccgcaacgcttgcggggcaggttgcgcttttaaaaagatgcttatcgacgcacccctccttctgcatatacgatcgagcacatctaacaaaaggcaggggttcaggcatgtattccaacaatttgtttctcttatccgtgtctgaagatagtgaagaatatgaatgctgcgtcggcctattagatggttcagatggacttgcttatatcgagaagcttctcaaaggaagaaggctgaagaatcatcatctagtgtgggatcagattgataaggccactatcgctcgtgaaccaatacacaaagggcaattggttcatctgatatttttgaccgcactaaccacacctggcgaattctcctttgtttacccaggtcaaaaccttatcgaagcaacacttgaaaaagattatgctgcacttgtacttgacgaagagcgcaaacaatttgtacctgaactgattcaaatgtggtcactccccgtcgggtgggtcgctcctgggcttgaagatttcttgtatcgcaattcggagtggtactaaatctaacctgactttcaccattttgttcggtcccgagttccgacctgatcagagcattgattgcacactgaccgttggacgatacatgtgctttaagttcgatttctcaccgtcgataccgctagggaaacagccaaaaacggcacgaaattggagtcgagaaattgagtttgcggtattgctgttgcgaactcgataccgtgaaatcgagattaataaaccacggcgtttatcgcttgtttaaggtgttgattttttccgatgggtgcttgtatcactcgagggcttaaaggccttgagaggcgattctgggaggttactttttcggggccttttgagcagtttttcaccgcagttcatttggagaccaaggatgattgtaggggacttagttttggtcatatatgacgttttatttgatctggtgaccaaggatctttgatcatcctatgtatttggtcgtatatgccggttttggaagattgccgcaaccagatcattaatttttcgcagctcaggaaaaacattgtgtgtgaggaggggtgaagtgtgctgaccttgcaatactgggagataaaacgacataagtgtgttagaaagtgtgccggattgtctgcttttacaccccaattttgaaaagaaagtttcccatcagcgcagattcatggcagactagacgttagtcgcgatttctattcgcagtgtttaggcgctgataagagatataactgtgagcgcctagttttcctttaccctgcagcatctgtgaaggtagatggtttgacgaggagttccaacgactcggacgctggtgaatcatgctggcgaacgtagcatcacctgattaggaaaaggtacaaatatggcacagggtactgtgaaatggttcaacggcgaaaagggatttggtttcatcgctcccaacgatggctccgcagatctcttcgtccactactctgagattcagggctccggtttccgtaatcttgaggaaaaccagccagttgaatttgaggtcggcgagggcgccaagggcccacaggctcagcaggttcgtgctctctaagctctaactgctagctaaaaattccgcttcgtccttttcggacggggcggttttttaatgggtggattgtgcccctcgagatcgctcaatcgtctttattttcaattcattaagtcgttgacaattcgtaaaattgcgtctagaactaatgctataacggggagaatgaaaagctttacgcacactgctcacttggcgcagtctggaaatccgaggaacatttcacaagcagaggggtggttgcttgtagttcaatctatgggaattgctgtattgcttgcagttagttttcagtcccatttgtgggagtggggtgggatcataaggatgctcgcccaaatcgtatttattatcttgattatcttggtgtctagagggcttgcgaagactaggcgggttcatcctcggggatttaaatggcgtcttacctgcgcaggaatcttaccggtagttgtggcagtgattggtggatggttctggacggctcccacatttcatgacacatcgtggataattacaacagcagtggcagtgggagcaagccttcctggtgctttggttggtttggaattagtggttagaggaaacaagtgaatctcgaagaagcacgaatcgctttgaatgacaccattcattcacctgttcgtctggcgttgatggccgcgttaaattctgttgattcagctgattaccaaagtcttcgtgaagaactgggcgtaagctactcgttgctttctaaacacgctgcaatacttgaacaagccggttatttgaaaatttccaaagcttttgatggacgaacacccatcactcatctgaatttaactcgtgatggacggcaggcttttcaaagttacctttctgcgctggatcggttggtacgggggttaacaacctagctttgtatctgaaggcttcggagatttcctgtatacatcaacaattgccctttaaccaggagtattcttagcttctatgactcctgatcttgcagcttttctggacaaactttatgccgaggggcaggaatttgatgcagagcaaccggatcggcttgatcgcaggagaaaccttgaatctgaaagcgctgcgctacttcgctcgctcatctacggaattagtccaaagtcagttctcgagctaggcacatccaatggttactcgactatttggatggcagatgtcgtgaatttaacaacagtagacaatgatcctgagcggtctttggatgctgcagcaaaccttcgcgccgctggagttgaagaaaaagttcaacgaatcgtcgccgatggagcaaccgtacttgccgattccgccgatgaacaatgggatttcattttccttgatgccgaacaatcactctatgtaaattggtggcctgacctgcaatgagttctagcaaatggcggcttgttagtggttgacaatgttctgtcgcaggccgatcaggttgtgtcattccgagaacacgttgatcaaactgaagggctccgatccctggttcttcccatcggtgcgggacttctcattatcgctaaacaaagctaggtgacggtgtcctgctgagcgagagagattacccgcgctagaccctttcttcagctcttttccacacgcatgcgtagcgttcccgatctggccaacgaggatcccgctcttttggcgagataacaaaaccaagtttgcgataaaaatccaccgcgtcatcatcggtctctaaataaacctctgggaagctcgtcgccacaacgtttagaagctggcttcctaggcccattccttgatgagattccaggaccgcgatgtactcaattaccgcccgagttggttcattgaaataggacgcaaacgcgatgggggaagcatcctcaaagataccgatggtggtcatctgggaaatctcatgcgtgatggtgtggtctaattgtgctgcagaatagccggaagcaagccacaaaaggtgagcgaactcagcggattgcatggcctctgggctgaaaatttcaattttcattattgtgcgcctctacctttaaacctttggagttgtcccacggacaatgagctgccccggaatgcttaagtggttttcggggagtggggcggcgtcgagaagcgttaaaacctgcgtggcagctgcggcgcccatggctgggaggtctggtgcgaaaacggtgatgccagggccccacactgcgagccattcggcgacgccgtaacaagcaagtgccaggtcatccgatatttttatgccgttttcttgggttgctttgagaactcctagagttaattgcgtgctcaggggcaccacgatttgagggagatcattgcggaattctgcgaatgcttcataaccgccggtgggggagtagcgggagtgaactacccggaatcgtagttcttcgcggattccgcgttgtgtggcttcggtttcgagggcgttgatgaatccggctttgcggtctcgggcggtgctgagctcagcaggaccgacaatgatacctatatctcggtatccctgatccaaaatatgaagagcaagttccttcaaaccagtggcatcatcgctggtcacagtaggtcggttgagatcgctacgacgattaagctcgaccactttgaagccctttggaaacttcgcttggggattaactggagcgtgcaccactgcatctacctggcggttgagcatggattcgatagctcgacgttccttttctgcgtcgtttccagttgtggaaacaactagttggtatccggatttgtctaattcatcttggaggacagtggcggattcggtgtagaacttattgataatgccgggaacgatcaggccaacggtgcgggtcttgttttccctaagtgcacgagccatggcgttggttcggtacccaagtttctcggcggcggcgagtactttgtcacgggttgctgcatcaacggaacctcgtccagaaattgcgcgagaagcagtaccgtaacctactccagcttcacgggcggcgtcagttaacttcacattcacaccgttaagcctatgcgttggggtaaaaattatggcagattggtgcttaagtaatggactgttttcaccctttaaacttctagatttaaacacgaggggtttcggtagcacggtttagtaacttgtcaaaggcttgcaaatacccactgctactactctgatggcgattaagcgaactttactatgactcgaaaatttagaagactccacgatctcggatatttcatcattccgtttgttgaatttttaagtattgcggcaggatactttcttattaaaactgcagcggatgagtttggaaagcttaattttatcgggacgattctcgtagtcggaggggtcgtttccctgtttaccgggtggccacttctattcgcaagagtgaatgattttaggtgggatgcagtttaccttgtgggtggagcggtatttttagcattcctttttctggggccaaaggaaatgacagttcttggactggtggcgatgtttgctggtccgggaatgctaatagcagggttttcatatctgagtcgtcgtattattgcgtattttgtggaattgaggcggttgcaacctagtgattaagaggctgtgatcacaccatggcttgaagcaaatggagaacagcttgaagcgccacaaatgctcatacggtgtctgcaagaaagacatttgtaaagctgctggtagcccaggtaaaaaatgaaatcactgcaatgcgtggatagtcctgggaaatatgctcacagtggcggttgaatttaaacaaaagcgttgcgcgtgtggcattgaaagcggtggaactacctattggatatgagtgtgcttcactcccgaattcggtgatttggaatccaaactttaaagaaaaacaccgctgcccctccacctgcgcgaagcaggggaggggcagcggctgagaaaaatctggagcgtgttatctatgcagtgtctgggtttttagtgcacctttccttttcggatgtccttgttgaaaatgacaccggaagtaacatcctcatcaatctcctccaaggtacgtccacgagtttcaggaacctgggtgtagatgaagatcaaggcaaccacaccgattccggcgaacatgaagaaggttccggttagtcctactgcttccatgatggttgggaagaacaatccgaggaacgcgtttgcgatccagaggaagaacactgagataccgattgcgaaaccgcgcattgccagcgggaagagctcagagagcataacccaggtagctacgttgaggaaggtctgcatggatcccacgaagaccacaaccagagtcaagataacgtaggggcgaagaggatcgccgactgggaatgctacggatgcgataccgatcaatacgtggctaatggtggtgagagaataaccggtaatgagggtggtacggcggttgatacgatccatcatccacagtgcgatgaatgcaccgacaactgcgatcactcctggcgccacgttggcgatcagagctgcattctcggagaaaccagcctcaatgagaacaacctggccgtagtacatgatggagttgatgccggtcagctgctgtgcgacacccaatccgatacctaccaggaggatgcgcacaagccacttgctggacaaaatttcccttaagcccatggacttctcggaaacggcgtgctcttctcttgctaggtgttcaacatcagcaacttctgcatgggcacgttctagagggcgaatggtttcaagaactgcgcgagcctcatcaatgcgtcctcgctcaacaagccagcgtggggattctggaactcggagcattccaaagaagagggcaattgctgggattgcggcaattgccagcatgtagcgccacacaccatcgtggtgtccaaaaacatttccaataatcgcattgatgacaaaagctgcgagctgaccaacaacaatcatcaactcattacggccagccagtgagccacggatttcaaaaggagcaagttcagccaggtagacagggacaacagtggaagcgccaccaactgcgagtccaagaagcacacgtccgacaaccattactgcaaaagatggagcaaacacgcagatcatggtgccgacaaagaaagctactgcaagtgagatgattgttttccggcgaccccagttgtcggaaatgcgaccgaaaaacatcgcaccagctgctgcaccaaacagcagggaagaagttacaacaccctcggtgaacgcggttagtccgagctcacgtgtcattgggttgagtgcaccgttgattactccggtgtcatatccgaagagcagcccaccaaacgtcgcaactagtgcaacgtagaatagccgctttctatacggaccttctgtgagtgggggcagcttcttacttttttcagggctgtcggcctgaatgaaggtactagccatcttgtctcctaagtttgtcgtgcccttacttggaggtgcagggtcacgaaacacgatgtagtaggcagtgattcacatcaccaatgtctttaatcgtggcagacacgatatgtcccgtcaatcgtacataacaaactttttttgaatacttttgagtaattggtaatacttaggggtgggggtgtctgcttgggtatggttttccattcgggattttcagcaggggtgtggctgttagctgcggtttgatgcaggagttatgtggttaatgtcagaaactgccccctctggaaatgttggagcatgggagtttctggataagggtgcgggggtggagggggtagtgattggggctgtttgacacctttgttaggtgacattgtcacctcattcactgcttaaagatcctaatgtcattacaaaaagcgtgcgaggagcggacatcgggaatggtggggcgataatcgcccgtttaagcggctcgagacgtcgatcgaccacttgtgtcaaagtgggcacaaattgccgtcaggcggcgctctggaacgtcatcattttgggactggtggggcgaatgtgaaacctgggtgtttgctgatcaatttttcaccacaggcgtgaggtctggccataaagtcgaacgaatttttgcatcaaaccctaggcgggttcagggggtgaatgcaccacgagcaacccgaagggtgcgaagtgggcattcgtagaacaatcccagaggaaagccgtacggctttcctcgacatgatcaatcaaggtatgtcaggtcttgctgcgtctacagcggtcggggtcagtgaattcaccgggcgaaagtgggcgaaggccgccggggtgaaactgacccgcggcccgcgaggtggcaatgcttttgacaccgccgagaaacttgagattgcagccagcatgctagagaaaggatgcctaccccgagaaatcggcgagtatgtcggcatgactcgggccaatatatccctatggcgcaaacaaggcccagacaagcttcgccaacgcgcagccaccttgcgcaccggcaagcgagcagctgaattcatccacgccccggtgatgggcccttattatgggccacgcacactccatcaagtgttgcgtgaggactacacaacactgtttgacgagttatctgcgttggggttgccagcacaggtgtgtggggccttacttcatcttgctccaccaccatcattacgcttttcttatatgtcgtgtgtagtgccgttatttgctgatgaaatcaaagtcgtaggacaaggcacacgattatcgttagaagagaaaatgatgatccaacgtttccatgacaccggggtcagtgcagcagaaatcggtcgacgcctgggtcggtgtcggcaaacaatttccagggaacttcgacgtggtcaagatgatgatggacgttatcgtgcacgcgactcctatgaaggtgcgatcaggaaactagcgcgtccgaaaacaccgaaacttgatgccaatcgtaggcttcgggctgtggtggtcgaggcgttgaataataaattatctccggagcagatttctggtcttttagccaccgagcatgctaacgatagctctatgcagattagtcatgaaactatttaccaggcgttatatgttcaaggtaaaggggcgttgcgtgatgaattgaaggtggagaaatttcttcgtaccggtcggaagggacgtaaaccgcagtcgaagttgccatcgagaggtaagccgtgggtggagggtgcgttgattagtcaacgcccagcagaagttgctgatcgtgctgtgcctgggcactgggagggcgatttagtaattggtggtgaaaaccaagcgacagcgttggtgacgttggtggagcgcacgagccggttgacgttgattaagcggttgggggttaatcatgaggcgtcgactgtgacggatgcgttggtggagatgatgggtgatttgccgcaggcgttgcgtcggagtttgacgtgggatcagggtgtggagatggcagagcatgcgcggtttagcgtggtgaccaagtgtccggtgtttttctgtgatcctcattcgccgtggcagcgtgggtcgaatgagaatacgaatggattggtcagggattttttcccgaagggcactaattttgctaaagtaagtgacgaagaagttcagcgggcacaggatctgctgaattaccggccgcggaaaatgcatggttttaaaagcgcgacgcaggtatatgaaaaaatcgtagttggtgcatccaccgattgaattcgccctaggttggatgcaaaaatccaccacaaacatgtggtcagtccacatgaattgaacgaatttttgcatttggaaccggcatgtcccgataccatcaaaaaacctcaccgcgcacccaagaatctccttaatggccctcgatttggcgttccaactctttgattcggatccgcagggcctttttctcatcccaattggcggtgacatcgcggagaaaagctgcaacgccttcgatttttccggaatcgtccttcaggatggtgatggagaattccaaagacattttggatccatcggcacgaatgcctggaacgttaagcggttcggagccatagcgagtttcgccggattccatgacgcgatcccatccgtcccagtgggccttgcggtgtttttcgggaatgatgatgtcgagtgattttccaagggcttcgccggccgtgtatccaaagagtttctcggagccgccgttccagagtctgattattccatcgcgggtggcgtagatgattgcttcttctgtttcggtgacaagtcgggctgcgatggtgtcaaaatcgaccatttttatcttctttcacggggtggataggcgaacatcttctaccatatcctgtgatgtgtaacacaagagcgtaatctgacctcccgttttcctataggttgatcgaaagtaacccttttgttacttgcgttgcaggtagtgtccctgattttcttattatcgaacgattgatagaaacaggattaaagtgaggtatcccgcatgaaaccacaaggactctacaaccctgcgcatgaacatgacgcctgcggtgtggcgtttattgcggatatccacggtcgacccagccgcagcattgttgatcgtgcacttgaggcgcttcgcaacattgaccaccgaggtgccgccggtgcagagaagaacactggcgatggtgcgggcatcctcatgcagattccggacggcttttatcgtgaagtatctggcattgagcttcctgaggcaggggagtatgccactggtattgcgttcttgcctcgcggtcgcatggcgatgatggatgctcagaaggaaattgagcgcatcgcaaagcaagaaggtgccgatgtgcttggttggcgcatggttccttttgattctcgtgatttgggttccatggctgaggaggcgatgcctagtttcgcgcagattttccttactgtgcctggaaaatctggtgaagatcttgaccgtgtgatgttctttatccgtaagcgttgtgagcgtgagctgggcaccaccaatggtcgcgatacggtgtatttcccgtcgctatcttcacgcaccatcatttacaaaggcatgttgaccactctgcagcttgagggcttctttgaggatctgggtgatgctcgcctggagtcggccattgctattgtgcactcgcgtttctccacgaacactttcccaagctggccgctggcgcacccgtaccgtttcgttgcccacaacggtgagatcaacactgtgcgtggcaatgaaaactggatgcgcgcccgcgaggcgcttatcaaaaacgacaagctgggcaatttgagcagcgtgctgcctatctgcaccccggagggctcggataccgcgcgtttcgacgaggctttggagcttttgcacctgggcggatactcacttccgcatgctgttgcgatgatgatccctcaggcgtgggaacacaacaagacgctgagccctgagctgcgtgatttctacgaataccactcttgtctgatggagccatgggatggtcctgcagcgctggcatttactgacggtcgttttgtgggtgccgtgctggaccgtaatggcctgcgacctgggcgaatcaccattactgattcgggtttggttgtgatggcttctgaatcgggagtgttggacttgagggaggagagcgtcgtaaagcgtactcgcgtacagcctggacgcatgttccttgttgacactgccgagggccgcatcgttgaagacgaggaaatcaagcagaaattaagcgaagcgcagccatatggtgagtggattcgcgataattttgtgcatctggatcgtctgcctcagacacgctacaactacatggcgcactctcgtgctgtgttgcgtcagcgtgttttcggaatcactgaagaagatgtggatttgttgctgctgccgatggcccgccagggtgctgaggcgattggttccatgggttcggatacgccaattgcggcgctatcccagcgaccacgcatgctttatgatttcttcgcgcagcgctttgctcaggtgacaaacccaccgttggactctatccgcgaaaagcctgtgaccagcatgttcactttgttgggtgcgcagtctgacgtgctcaatccgggtcctgatgcggcgcgacgtatccgtttggaatcgccgatcattgataaccatgagctggccaccttgatcaatgccaacgcgcatggtgagtgggattcctttggtgctgctgtaatttctggtttgtacccagtggctcaccatggtgccggcatgaaggctgcgattgctcgtgtgcgccgcgaggtttctgaagcaatccgcaatggcaagacgttgatcgtgctgtcggatcgtgaatctgatgagcgcatggcacctatccctgcgctgctgctgacttccgctgtgcatcagtacttggtgcagcaacgtacccgtacccagtgctccctggtggtggaatccggcgatgcccgcgaggttcatcacctggcgatgctcattggttttggtgccgatgcgatcaacccgtacatggcatttgaaaccatcgatgagctgcgcatgaagggtcagttgggtgatctttctttggatgaggcatcccgaaactacatcaaggcagccaccactggtgtgctgaaggtgatgtccaagatgggcattgcaacggtgtcttcgtaccgtggcgcgcagcttgccgatgtcactggtctgcaccaggatctcctggacaactacttcggtggtattgcttcaccaatttctggcatcggtctggatgaagttgcagctgacgtagaagctcgtcaccgcagcgcatttttgccacgccctgaagagcacgctcaccgtgaattggatttgggtggtgaatacaagtggcgccgcgaaggtgaataccacctgttcaacccagaaaccatcttcaagctgcagcatgcaacgcgttctggcagctacgagattttcaaggattacacccgcaaggttgatgatcaatccactcgcttgggtactattcgtggactgtttgagttcagcacggaccgcaagccaatttcggtgtctgaggtggagccggtcagtgagatcgtgaagcgtttctccactggtgcgatgtcttatggctcgatttctgctgaagcccatgaggtcttggccatcgccatgaaccgactgggcggtatgtccaactccggcgaaggtggcgaggacgcccgccgatttgatgtggaacccaacggtgactggaagcgctctgccattaagcaggtggcctcgggacgtttcggcgtgaccagccactacttgaacaactgcaccgatattcagatcaagatggcacagggcgcaaagcccggtgaaggtggccagctgccaccaaacaaggtgtacccatgggttgcagaagtccgcatcaccaccccaggcgttggtctgatttcccctccaccacaccacgatatttactccattgaggatctggctcagctgatccacgacctgaagaacgctaacccacgcgcacgaatccacgtgaagctagtggcagaacaaggcgtgggcaccgttgccgcaggtgtgtccaaagcacacgctgatgtggtgcttatttccggccacgatggcggaactggcgcatctcctttgacctccctgaagcatgccggtggtccatgggagttgggcttggctgaaacccagcaaacgttgctgctcaacggcctgcgcgatcgtattcgcgtgcagtgcgatggtcagctgaaaactggccgagacgtggttatcgcagctcttctcggtgccgaagaattcggttttgccaccgcaccgctggtggttgaaggctgcatcatgatgcgcgtctgccacctggacacctgcccggtgggtatcgctacccagaacccggatttgcgttccaagttcaccggcaaggctgaacacgtggtcaacttcttcaccttcatcgcccaggaagtccgtgagtacttggcacagcttggtttccgctctattgatgaagccgtcggacaagcccaggtgctgcgcaagcgttccggaatcccagctgattcccgcgcagcacacctggatttgagcccaattttccatcgcccagaaactccacacttcccaactcaggatgtgcgttgcaccaagacccaggaacacagcctagaaaaagccctggacaacgcatttattgataaggcttcggacacgatcacccgtgccgcagcgggtgtggaaaccagcattgttattgatagctccatcagcaacgtcaaccgttcagttggcacgatgctgggttctgcagtcagccgcgtggctggtgcccaaggtttgccagacggcaccatcaccttgaatcttcaaggctgcgccggtaactcctttggcgcgttcatcccacgaggcatcaccatcaacctcaccggcgatgccaatgactttgtgggcaagggattatctggcggaaagattgtgatcaagccttccgctcaggctccgaagcagctgaagaacaatccaaatatcattgccggaaacgtgcttggatacggcgcaaccagtggtgaattgttcattcgtggccaggtcggcgaacgtttctgcgtccgtaactctggcgccaccgcagtggttgaaggtatcggaaaccacggttgtgagtacatgactggcggccgagtcctggttttgggcccggttggtgagaactttggtgccggcatgtctggtggcattgcatacctggctaattccccggacctaaaccagaagatcaatggcgaattggtggatgttgttccactgagcgctgacgatctgacgtgggctgatgagctcattgctcgccaccgcgaactcaccggatccgagaccaagctgcgtgcacaagatttggtgaaaatcatgccgcgcgatttccaaaaagtactcaacatcatcgaaacggcccacgctgagggccaagacccagcaatcaagatcatggaggcagtgagctaatggccgacccacaaggattcatcaaatactcccgacgcgagcctgcacaccgcccggtcccgctgcgcctcatggaccactccgaggtctacgaaaaggcaccggcaggtcagatcgaggaacaggctgcccgctgcatggattgcggtgtcccgttctgccacgaaggctgcccactgggcaacatcatccctgagtggaatgatctggtacgccaaggtcggtggaaggaagcctacgatcgcttgcacgcgaccaacaatttccccgagttcaccggccgtttgtgccccgcaccctgcgaaggcgcctgcgtgctcggtatcaacgatgattctgtcaccatcaaaaacgttgagctggaaatcgtcgaaaaagcattccgcgaaggctgggtgcaaccagtaatcccatccatgtctaccgggctgtcagtcgccgtcgtcggttccggccccgctggccttgccgccgcgcagcagctcacccgcgcaggccacagcgttaccgtctttgaacgcgacgaccgcctcggcggcctcatgcgctacggcgtgccagaatacaaaatggagaaccgctggatcgaccgccgcatcgagcaaatggaagcagagggcacaactttccaggtaggcacctcgccgcgcgccgctgaactagcgcttttcgacgcgatcctcctcgcaaccggcaccccagtggcccgcgaactctcagttccaggccacgatctcaacggcatccatgcggcaatggattacctcaccgcccaaaaccgcatcaacgaaggcgacggtgaagtctctccaatcaacgccaaaggcaagaaagttgtcatcatcggtggcggcgacaccggcaccgactgcttcggcaccgcactgcgccaaggagcagaatcagtcacccaatttgatatccgcccccgcgctcctttccagcgcgccgattccaccccatggccgatgtaccccaacctcttccgcaccgcaacggctcacgaagaaggcgaatacatcatcactggcgatgaatcagccgatgaaatcgcagccctgggcctcgccgaacgtgccgcaggctccacgcttggtgaacgtaaatttgctgtcaacaccgtggaattccacggcaacaacggccacgtcaccggactcaccggcaaccaaatccgagttgtcaacggcaaacgtgaaccaatcgaaggcaccgaattccccttcgaagcagacctcgttcttgttgcacttggcttcaccggcgcagaacaaggcggattggcacacgaactaggcgtaggtttcgacgaccggggccgcatcctccgcgattccgaataccgcagccccaccaactcccgcgtttacatcgcaggcgacaacggccgtggccagtccctgatcgtgtgggcaatcgccgaaggccgcgcatgcgccgcagctatcgacgccgatctcatgggtgaaactgcactccctgtagcagttgcaccacaggacgtgccgctggctgtctagcttgggtagaaaatgctagaaaccaccatcagtaattggtggtttctagcgttttacgggatgcatcatcgcatagacagcactggctagtcctagcagggcaaatactagataaacagcagctgatgccagcgcaaaaagaacagaactcgaccacaccacaagttgaattgccgctgctccaaagagaatcacgactgcaaaaccaacaactggggacgtggtgattaaccacaaaggtcgtcgggctctggtttcttcagaagatcggaagaacctggtcagcacataaattgaaatcgttccaaggattgctcccagtgcttaaacctctcgaatgctgtctgggaacacggaagcggcggcaaaagccccgaggaataaaacgatgaataccgccaggagagaaccgatctttgtggtggcgttgtacatcattccgggtattatctttccttgccgttttacgaaccaatagcccatgtgtggacaggttggccgctttcttgattctgtaaatactgttgcaacattgctgcaagacctgcttttcgagcatcggaacccggcatgcttccgtgtgcttccagcttgttgaggctacgcaactgccaggtggcaccgttttggcgggacttcgcgcgttcggtgatgatgcccaggtattggtcgataaggtctttgtttacttcgagtcgttccagtccgattctggcttgagggatgaggtgctcttggaccagattcgcaacgttgacttgtccgagggttggccaggtcatgcgggcgaacagccctgaacgtgcaccggattggaagttcttttccgcatcagggaataggagacgtgaccagacagggcggttttcctcggccagatatttaaccaaaccgtagtagaaagcggcatcggcggtgatgtcgatgggggtgggacctgcaggtaggagacggttttccaaacgcagatgagagcgctcttcccccggtgcgtaaatgggtcggttccagcgccacaccgttccgttgtggagattgaggtagtggagtgcgggggattttcccttcatcattggtgtgccagacagggcgcgggattctgcgatgagaggggagaagtagcgtacgttttcttcgaaaagatcaaaaacactggtgatccatcgttcgccgaaccatactctggggcggactccttgattcacaagttcaggagtacgcgtatcgatagcttgttgaaacactggaatgcggctttcatgccacacccgacggcctaggaaaagtggggagttggcggaaagagctgcttgaacaccagctattgcttgcgacgcattccacgctgcagcaaacttattgggtgctaattgcaggtgcaactgaatagacgtgcaagttgattcgggggcgagatcagtgaaatcgtggatgatttgttcacggtcggcgatgttgatgtgcactaactcgccacgcgattccatcaccgcattgctcagcgcacggtagcggttttcttgggtcatccatgccggatcttcgaggaattctggggtgatggtgggcagcgtgccgatcatcgccacgttcacgttctccgatgtggcggccgcgcgcacgcgacctagacgcgaggtgatgccttgctcgaggcgtcgtaaagcatcgcctttaacggatagtggcgggtggttcatttcaacattaaagttaccgatctccgactggtactcatcgtctaaatgggaaagcaccgcgtggcctgccaaagcaggttgcatatgcttatccacgaggttgagttccaactcgaggccgatggaaccctgatcctcaaaatcggaatgctgcaaatgccgatcaaaaatctcaagatcttccatgagcagctggcgataacgcgtgcgctgctgcggagtgtacctgtcagtacttactgattcgcccataacttagagcaaaccacaaaaaatggtgctgggtaaggatactaatcaggaaatttccgcgcgataaacccgggcgactaattgagtgcgcgatctgactttgaaaatatccaacaactgggacaccgtcttcttcactatcgccatcattttgcaaaaatcttggtgtcgtgctcgctggcaggggttaaacaccaatggatgtttcccaacagaccccctaaaccacaaaaatgcggccactcttcaaaggagtgaccgcatctacttaaaaacttccagtactgaaggtcttattcatctaccttcatatgccctggattccagagtccggaacgttggatggtttcaaggttgatgtctgcaaccttaggtgcatcgccgttggagttggtgcgcagcgagtagcgttcgatggaaccccagtcgcggccccagtcgttgcggaggtaggacgggatttcgtaggcgttgtttactgcttcggccgtgcccatggatccgccgcctgcccagtcttggaatggggagagggtggattttccgccgtggtctggggagattcggtattcaggaatctcggtgactccggcgtagtggtcgaaggtgcgttggcatgggaattgcaggccaactgcccagtcgaggagtcctggggtttcggatccgatgacgttgttcagagaatctaggttaggtacgcgtggtggcgtcagtgctacccattggtcttcgtcgaggttgacgtcggtggcgacgatgcgcacgacgtccgcttcttctgggagttggtcaagtgggtagcggaggttgcgccaggatggctcggggccgatgtcgtacatcatggcttcgccgaggtcttcaacgtcgccgttatcgcgaaggcgaccgtattcgagcatgacggattgtccggattggcggacgccgttgatgtcgtagtgttcgatgcgacctgctgcagataccacgatgatgggtgcttcttcggtggcttctgggatttcgtaccagtcggtggtgatgtttgctgggttttgggtgccagcggaccaggagccgacgactggaacttgggtgtagtccaggttgaatggcaggcgggcgttggagccgttgatgccttcggagcctcggacaccgccggtgttgccggtggattgtccggatgattcgtcggatccgccggtttcggtggagtcgtcagtgttggcaatggcaccaacagcagacaggtctgcttggtcctggctgattgatggtgggatgccggcagcactaaagccgcgaatatcttcggattccagggactcgccaagtgtggagttcactggagtgaggaaggaatcgttggagttggtttccagcatggcgtcggaggcaaggccacatgtgttgccggtcagggagcggaggttgccaagacccacggagtacgcggggtattggtccacaaagcctttgcccatggatgcgcaggtaatcagcacaacgagggcggacactcctgcgataggggaggccgcaaggccggtgaacctggaggcacgctcgcgctttgcttcatcttccgccacgagttcgcccatggagtgattggtttcggcttgcgcggttttcacatcgtggacaaaggattgaataacaccgatgatcagcacgatcacggcgatcacgagcactacggtggatgcttcgatgcccttgatctggatggttttatcccaccatggcacggcgtagctggaggtgtaccagaatccgttcacgcctgcgagagccagcgccagcaggaagaggaacgcaccgatggaaatggtgcgcatgcgtggtgatttcaccgcaacataggacagccccacggcagcaagtccggccaatgcgccggcaagtcctgcgtagacaccgaagtggtgagtccacttggttggggtgaacatcatgaagaacatggtgccgaaaatgaccatcatcaaacgcagtgatggtcccttcgcagcgcctggaatgcggccgtaacgcaggatcgcgatgaccacaatagccagacacgccatgagcatcagcacagcaaaacggcgggtgaaggaaccatcaacggtttgttccatgacggtttggtagcgcacatattcgtggtaccaggtcagtgccgggcccttcgcggagcgcacgctgatggattccatgacggttgacagagtctgatcgccaaaaacggcgatgagaatcgcggtgccagacgcaaggaatggggcaagcatagccatcgaagcgccaaagactttgcttttcgacgcccccctcgacgccccaataagcggcaagcgcctataaagaatgcgaatcaacgcggacaaactgaccagcaacgcagcaactgccattagaccggtggggcctgatgccagggaaatggtggcgataatgacaccaatggcagcgggcaacaacctggaggtagcgatagcgcgctcgaaggaaacccacgcaagtagagctcccatcgcgatgattggctctgggcgagtgccgttgttgtatggaagccagaacgccaggaacaccatggctgcagaccagtgcgcaacgcggcgaccgttaaccaatgagccaaaccgtggcatgacctctctggtgatcacgaaccacatgatcagtccagcgagcaatgcgggtagacgaagccagattgatgaggttgagatgtaggccatcagagccagcaagtcgtaatatggtgcgccgaatggtgattctgggacaccgaaccagcggtagtagttggccatataatccgcgttctgggacacgcgggccatggtcatgatgaagccgtcgtcagaggtgttggcgccaaggaagtgccagaacaccaaaatcgctacgacaacaccatcaagtggcttcagcttgtaccagttggcaggcaggaagcggtgtgcttttcgaccatccaaaatatccatgcggtgcagtgtccacagggagaccaacacagacgcaaggccaatgaagatggctgcgtactttagaaggctgggggatgaagtgaagcgggagttgatctcaatatcaacgtttaagcccgctgaggccagggccgatgcggtggaggggtcgtcgacaagctcggtgtaaacgccggtgacctgaggccgctcatcgccttcggtctcgccgctgaatgccgtgccggtgatttccgcgctggtggtttcctcggtggaggaaatctctaggatcgcatcatctggcagacggttcacctctgttggtgaaagatccaacagcacctcaccgcgaacaatcacgtcaaggttaccgtcgatggtgcgcacaaacagaccacggttggtggcgtccgtactgtccagaggcaacgtgcccatcaccaacgactgattgtcattgagactgtccagcgcggacacagggatggacgcatccatcgactgcggtgcgtaggaaatcagcggggcgttaacgctggaaagctcaccattttgtggccatgacagcgaagactgcacctggttcactggcaggaaaggcaacagcacaaacatcaacaggccaagcagacctgatgagatagccagtttcttcagccagcccggggcaacctgcgggggttcttgcgcagaaccctttagtttcttcgactcaactacatctgacacgttgatcgagtctagttgatggcccccattaccaccgacttggcgcatagggcttgggtcgtttggtgaggaattactcattgtgcgttaccaccacgaaaggtcccacttgcttggtctgccacatctgatcaaatgactccgggttaaagtacacgccgcggaagcgcacgtttggattgttcgggtacagatcttcagccacgtcgtatttccaaccggcgtcaggatcatcgatggagccacggaagatgaacacctcagggatcgtccatggagaggtgttcaaggcgtcgctgaattgttgaggatcagccaactcatcccagcttcggatcgcgagatcttcgatgaatgcgttcctgtttccgaactcaccaagcgggttggcgtagtgggaagtaaaagcttggtatccgcgataagggtagtaggacatgaaatcgagttcgtctgtcagcacgacagtttcggaaggctcgaatccttgatcaagcagatgatcgttgatgtccttgtaataacgtgcagctccggccggatacagatccgcgcgctcgccgtagccatcagtatcggtataggccagatcgatagctcgtgcgttcttctgcggcagatcttgcgcgtagtagaggccgccaagcagcacgaggaccacaattagattggtcagatgggtggccgtgcgctctgtgatttgggtggggtagagctgatacacactggcaaggcggaaatctgcaatgcccaacactccagccgtggcaaaaataagcaccagcaccgtatcaagacggaatccaagcaacgtgttgcccaaaagcgtgatcgccatggacatgcccatccaggcataaaacactgcgatgccgacccacatcgcgcgcacctcattgttgtggaaacgcaccaccaaatagatcaggccaacaagacacaacagtcccacaacgcttgatgccaagaaaggaaccgggaattgggtgccttcaagaggcaggtagtgtgttgcggaatcgccagagcgctccgctccgttgatggaggccagaaggtaaggaccccaagaaatcaacgcaatgacaatggatccaccacccagcactgcaagccacagcagtggtttgatggagcgctgcacaatagccgccaccacgatgcacaccgcgaccgcagaaagcgcgatagcaccggtgaacaaagtatagaaagtagccgaaacacccaagtaaataatgccgccggcaagcgcaaacttatcgcccttggcaatgcgggaagccagcacgagcatcgctggaatacccatcgcaacgattgcagcgtagggctcttcggaattcatcgccaagataatgcaggttgtcaccaacgcaatgcctgttgccaccggcagggaaccggtgatgcgctgccacactggaactaacacagaagcagcaactgccatggacacaattgcccatggctggaaagcttcccaaccgggcagccccaaaagattggccaagcgaccaccgagccagaaccatccagcagggtagaaggtaggcatatcgatgtagttcatgtccgacaagccgatatcgtcagccatgcgggttaaaaactgagttctaaagccctggtcaacgctgattccgtccaaatacaggcgggtcgcagacagcggaatagccaacaccgcaaccaccagcgcagctgggcttaagtaagacgccagatacgtcagcgccgtccgccacttgggccttggcttgacgtcctccaactcccaccgcggattgctctgatgttcatcgcgcagccacagccacgtcaaaaaacccgtgacaatcaaaaccgcagcgatggtggcagaagcaacagccctcgtgacattcgatgggccgaaagctggaaggtttgtttgttttaaacccatccacaacaccaaagcaaatgcgaaagccaggatggcagctcccacaattgcaacaagtgtagctttcctgtttagacgatcaggccgatacacttcgccttcaggcacacgtgatggaccataaggattcaaatcctcatgaaccacgactgcaccttcatcttcagaggtgttaatcatgatagaagtctttcatactcaacgagcattgctgggatcgaggagcaaaattacaagtatgtattaatgagtctcacgtgctatctgctttcagagcttgccatatgtaaaacccgccatcctttaaaaattttgaggacggcgggtcgcgtaacttccgtaacttccgttagaacggcagcttgcggaagattgctcgcggaatgaattggaacgcaaaagagacgtactggaacagtgggtggacaaagatgatgtccttcttgttcaccactgcatcataaacagcatctgccacgtcttcgcggttgacggtcagtggggcttcgccaccatctgcggacatcttggtgcgtacctggcctgggcgaaccaccaatacgttggcaccggatccacgcagggcttcgccgagctgggtgtagaaaccgtcgaaacctgccttggcggagccgtagacaaagttggagcggcggactcgctggcctgccacagaggacaatgccacgatggtgccgtggccctgctgctcaaatttctggcccagcagtacacctacggaaacgccggcggtgtagttcacggtggttgcttccactgctagtgcttggtcgcgccactgtgcttcgttgtcgccgaggatgccgaaagccacgattgctacgtcaacgtcgccgttttcaaaggctgcgtcgatggctgcagggtgggattcggtgtcgagcgcatcgaaatcaacaacagcaacggaagcagcgccagctgctttgatctctgcgactgctgcgtccacgcgtggggaatctttacgcgctgccaaggtcacatgggatggaccctgcttgaggaagcgggagacaatggaaataccgatctcagaggttccaccaagaaggagaatgttttgggctttgcccactgcgttaagcattgtttagttcaagccctttcttaagaaagctcaagtcggcgggacatgtcagatgcaaagactccggttgggtcgatctcatttcgagtcttcaaccagccttccatacctgggtacatggcgtggaagttctctgcggaggtgcgggattccttggccaggtagaggcggccgccgaattccatgacgcgcttgtccagatcgtccaagaaagctcccagacctgggcggatagggaagtcaacgcagacgttccagcctggcattgggtaggacagtggtgcgcggttgcctgggccaaacagtttgaacacgttgagtgcggagtagtggccggacttttgcatatcgcggatgatgtccttgaaaggctcaacagcttctgtggggaccacgaactggtactgcaggaagcccttggagccgtagccacggttccattcgccgatcaaatccagtggttggtagaactgggtgaggtttttcacctggtttttcgctggtgcacccatggcgtagtaagccacaccgactgcggaaagggtcagcttgttcaaagtccaggatgggaagatatctggaaccttcatcagctgtggagcattaaacttcagtggatccttggccagctttggtgccaattcttccagctgagcaagtgttgccagggaaccacgggagatggtggagcggccaagctttggctcagggctgatgacatcgaaccacgcagaagaataggtgtagttgtgctctgatccgtcggagtggaacgcaacggtttcttccaagttgttggtgcggtcggtgtccgcaatgaagtaggcggtttccgtcttggtcatgcggatgcgtgcacggacgatgatgccggtcaggcccatgccaccaacggttgcccagaacaggtcgccctgtgggtcttcggcggtgccttctggctcgaggtgcaggatgcgtccgtctgcaacgaggagttccatggagaccacgtggtcgccgaaggaacctgcagagtggtggttcttaccgtggatgtctggtccgattgcgccaccgatggtgacttggcgggtgccgggaaggacaggaacccagaggccatatggcagggcagccttcatgagctgatcgagggtgacgccgccatctacatcgacgatcgcagaatcaggatcaatcgagtggattttgttcagtggctgcatgtcaatgacaaggccaccggcgttttgggctgggtcaccataggaacgacccatgccacgggcaatcacgccgcgcttgaggtagtccggcttggagtcgttttgttcagcgacttggcggactgcatccacaatgatgtctaggtctggggtggtaagtacctcagcggtggtgggggctgtgcggccccaaccgttcagtttctgagcttctaggggaagggctccgtgggcaccggccgaagcgccggagctggacgtgccgtgagaactgttcatcgcctttaaaggttacccccgaaaattttcaggtggtgaagacaagcgtgaaatcgtccaatctcacatttattgcctaaagatccatgagttcacgaatctctgcggggatttcttcctgggagctaattgttgggccgtcgtattcccgaagcaggcggtagacctctgaacgtgaggtgctatcgagcagggggagttcctgggcgaagaggcgggtcatgaaatcgttaagcggaaggttggtgcgttccgccgcgatgtggacctcgggagccttggcttttttgaatctttcaaacatgcccaccaccttaatcagtgagtagtcttggcaacatggataccaggatgagattgcaggtagcagcaggttccgcgctgattggtgctggggttgcggttaatgattacgtacaaagcccagtccgccgggccatcagttatggtgcgttggcgctttctggggcgacggtgattgcgatgggtcaggacccgactggggagcggtccatcattgcgaaagattccgcgacgatggttgatcaaatccgccaggagatcggcgatttgggtgtcacgcctggtccagaatctgatgtggatgccatcacggagcgaggtccgctggtgacgtggctgttgcttgctgtttttgtcgtggcatttttcaccttggcgtatttctccatgcgcatggatgtggcggtgatgagaaggatcgctaagttctttgaaaaacgtggcgcttccaggccattcacctgcactggcatggtgtacgccgcttttatttacgcaatctgtgagctggaggcccgcacaaaatgacctatcccgtgttgagtgttttggataattctggcgatcacaacatcatctggcatgtgcaaacttatcccgcggcgctgcccaccggggcgtggattgccgatgagcaacaactgactgacctgctgaaagacacagtagtgttccttacccctgggagcaccgctccggaaaatgcccccgtggcgacgatagaaggggtgcgggttgacgtcgataagcaggtggcagagtacaacaaacatgggatccgcctgcccagcttgggcgcgcgcactgtggaggcgcagtaccgcggcgagccggaggcagaggctgcgtggcgcacggcgatggagctcgtagagatcgcaggcggctggctagaaattgaagccaagcgccgggcgcggaaggcgctggctgaggccttcggcgcggaggtccagccactgccgcttgacaccgaataggacaaatgggtctatcctggggcgcatgcccacgaattatgcacgcgacaacgtcatttccttggcgtctgcccgcgagcagcgttccgggaaacccgagcccaaacccgaactaacactcatcgtccgcgccaccaacgtgcaagcggacggcgaggtccacaggcaaattgggttgaactcggcgatgagcctggacgagctgcacaatgtactcaacatcgttttcggtgttggcggcgagcagtcaccctggcgtttcgaagaccaattccaccaacccagcgcccccgacaccaacctcggcgaactcctgcccgaacccggcgacttcctgttttacttctggggcctgtggcaattcaacctgcaatgcgtggaaatgtacccgcgcgacaacggcaccccgcgcgcgctgtgcatcggcggctccggcggcctcggcgacgacttcgaccaagccaccatcaacgccgaactcaccggcaccgacaccatccgcgacgtcctctccggcgtgcgccccgaagtcatcgacctcgtcgaccgcaccggcgtcttcgacttcatcccactgctccaagcgctcgacctcaaaagagaaccgcttatcgacgccacccgctaccacacctgccgcacgctgccagtggaaaacagcgccgaagcctccgacgcattctggtcctgcgtactcgccctgtcctgcctcggaaacgacgaacttttcatcgaagtgatcgaatccacaatgagcaccctcggctgggtcgccgacgacggctccccactacgtgcaccagagatcaccagcgcctgcgaagcctccctgaagatactcgcggaactcggtggctacggcccagagcggcttgcccccgtggatcgcctggacatttatagggagctgctgtgtttctaggtattgtgtaacctcgtgtccgaaaatcttgatgttacgatcgtccgaccaatgagcctgaaaacccaagctttccggttcatcctcaccggtggcctctcagccatcgtggacctcggcctgctgtcacttttgcagctagtgttcggccttcccgtacctgttgcccgcacgatctccttcatcgccggcaccaccaccgcctacatgatcaaccgccggtggaccttccaagcagaaagctccacctccaggttccttgctgtggtggccctctacggcgtgaccttcctgatcaacattggactgcaaaccctctgctccgcattgtttgagaattggggctggaacgaagccgtcgcgatggtggtcgccttcgtgatcgcccaaggcaccggaacggtcatcaacttcatcgtccaaagaaccatcattttccgagtgaagtaaggtacccctcatgaagaccttcaatcccaccatgattgccggactcatcggcgtactctacttcgtgctgctcaccctgattttctccatccaagacatggaactagcagcagaaatcgccttcggaatcgtcaccatcgtcggcctgatcgcggtgtgggacaacttccgcgaccgcaacaactccacctggaaaacctggaccggcctcgtcggcggactgctaatcgccgtccccggaatctgccttcttgtgggaaacctcgtgctcctcgcagtcgacggcaacccctcaaccatggtgaacaccctgctcagcgtcgcagggatcggcgcgatcttcctccttccgatcggcatcatcatgtgcctcatcgccggattcaaccgctactacgcagcccttaaggtctaaaatgcccggtctagttctctccacaaacgtcgcccatatccaacaagacccaggtggcgatgaccgcatcagcggcatcaacaaactccccgtcgccaccggcatcgatgtattcatccccggacccaactacggcgacggctccggcgtagtcggcgacgccatcggcgattccctccaccacggcggcgcccacaaagccatctacgcctacagccgcgaagaactcgacttctttgaccccacctaccgcaacggatacttcggcgaaaacctcaccaccagcggaatcgtgttggaagacctcctgatcaaccaacaagtgcgcatcggcaccacgctgctcgaagtctccattccccgccgaccctgccgcacgttcgcccactggctcgacatcaaaggctggctaaaaaccttcacccaacgcggcctccccggcagctacttccgagtcatcgaagaaggccacatcaaccccggcgaccccattgaagttctgcaggcccccgaccacgacatcaccatgtccatggccttccgtgcaaaaatgggaaacaaagacctcgcgcgccgggttgttgcagccaactgtctcccagcgcgctaccacgaggaactactaaaactgatctagggcctattgaatttctcgtcgcggcccagtttgtgcaggcgcagccactcccggaatcccttcacatcccgtttctgaaccaggaagaaccacgcaaagcgcgcatattcctgagggagaagcttgcgcattcccggctggctcatcaggtagccacggttgcggtaggtgaaaaacctcttgaaatcattatccggatactgcgtatgcatccgcccacccagaatcggcttgaactcatcagaaccatccgggtgcaaatacgccgtggtcaaacacgtaccaaacggcaaaccggaacgcaccaaacggcggtgatactccacctcatcgccgcgaataaacagtcgatagtccggcacgccaatgcgctccattgcataagcgctgatcagggcaccattgaacaaggaggcgatgcccggcagcaaatcatcctccgggttggctggatcaatcaactcactgcgcatccgacgccactccaagccccgacgcagcggaaatgccaaccgctccggatcatcagcattgcataccaccggagaaacctcctccagattatgccgagaagcggcgtcgataagcgtcttcaacacccctggcccctccggccggccgtcatcgtctgcgcaccacaccgcgtccgcccccagcgccaacgccgtcaaaaaaccaaaagcaaaaccgccaccgccgcccaaattggtgcgcgaaggcgtgtaaacggcacggtctcccgccacctctaaaaccagcttctcgacgtccggatccgccccattatccaccaccacaatgtgtttcaccggataggtttgattggcaacaacctcgagggaatgccgcagcaattccacacgattgtgggtcacaatgaccgctgcgacgttgatgcccggctggaggcgggtagtggtttgtgccatggcatacatcttgccacgccatcacaaatcgctcagattaacccgccccttcggcgactccaacaccaactccaacaacggcttaccctcctgaaaaattgcaggctctggcagctcatccggctcactatggccatagaccgtgaaactgtgaacactgacctggggttctgtgaccttggaaggatgcggcgaccccaaccaatcaatcgcaaacggcaccggcgcaaaatccacacccggctccggcaaaatcaaccgccacgtcagcgtcgtcccctccggagtgtgcctgctcatcaactgcgactgcgtcccccgcttagcggcgagagcctccaaatcatccggacgcacacaccacgccgccaccctcggctccgtcgactgcgtcgtagcgatcgcgaaattatcctgcgtcaccgcgtccgcctcaggatccgggccaatcaactccaggtacgacccctttggctcttttagtggcaccagcgcgttcgccgtccccgtatcgtgacgaccacccgccaccgccttaacccccgtcaacttctcaaaccgcgacaccagatctttaaggtttggcgctgcaataacaatgtgatcaatctgcgttcccatagggtcatcctaggcgtttcttggcggtggctttggttgctttggtgcggcggcgggcgaaagtgggcgggcttgttgctgggatcgtcgcttcgagtggctaacttgccctgtttgaaccgcccgatcacaacagggcgggcttggtgcggggaaggtcagttttggcggggagtccgccttgcttggtacaccagcgaacgaaagtgggccaacttgccgccaggccggtcacctccagtggctaactcgtcttgttttggtgtggcggcgggcacaacgaggcgggtttagtgctggagtggttggtttcggcgactaactcgccttgtttggcgcacccgcgcagaacagggccaacttgccgccagggtggtcacctccagcgactaaccgcccaaccgcgcaaacccgaaacgcaggagctacttttcttcttccatgcgggtgaggagtctgcggacgtggtcgccggcgcccttgccttcgtaggcttccaccacgtctggaactagtcccgcttcgcggatttgtccgtggtcgacccagagtgcggtgttgcagagttgggcgaggaagtcgttggagtgggaggcgaagacgaggatgccggatcgttcgacgagggcttggaggcggtcgcgggctttggccatgaaggcggcgtcgacggcgccgatgccttcatcaagaagcagaatttcgggctcgatggaggtgaccacgccgagggctaggcggatgcgcatgccggtggagtaggttcggagaggcatggagaggtattcgccgagttcggtgaagtcggcgatttcttccattttggctttcatctgtttgcgggtttgaccgaggaagaggccgcggatgatgatattttcgtagccggagatttctggatccatgccgacgccgaggtcgaagacgggggcgacgcgtccacggatgtcagcgcttccgcgggtgggttcgtagatgccggagaggagtcgcaggagggtggatttgccggcgccgttgtggccgacgagtccgacccggtcaccttcgcgcaagtgcaggttgacgttcttcagcgcttcgacgactacgacgttgtcttgattgcgcccgattgctccgccggctgcgccgaggaaggctttcttcatggagcgggatttggcgtcgaagatggggaagtcgacgcaggcgttgtatgtatcgatggataccatgtggtgctccttatacccagtagctgacgcggaatcgccattgcttcatcgcgaggagagcaaggccaaggccgacgaatgtgaaggcgaggacgatccaccagtggtaggcggggaggtcggcgccgaccatgggggcgcggacaatttcgaggtagtggtagagcgggttgagttcggcgaggcgtgcgcggttgccgatttctgcgctctgggattgcagggtggaagtcatccagacgatgggggtgacgtagaagaggagttgggttccggcttctagcagcggggagacgtcgcggtagcgggtggcgatgatgccgaagaacatgactacccacacgccgttgatcaccaggaggaacattgcggggatgatcaggaggacgtcccagccgaggggtcgggggaagatcatcatgagaatgacccagatgaccaggttgtgggcgaggaagagggcttgtttccacacgagtctgtacacgtggacggacagcgccgaggggagctgtttgatgagtccctcgttatctatgaagatgtcggagccttctttgatgcatccggagatgaagttccaaatgatcaggccgacggtgacgtggggcagaaattccgcgatggggattttgaacagcacggagtacagcaagccgagggcgagcgccatgacaccggtggcgatggtgatccacaggggcccaaggacggatcgccggtagcgttgcttaatgtcttgccagccgagttgcagccacaactcatgttgcttgaatccgcggacgatatcgttccaggcagcgccaaaggtcattgactgggaattcggaactgtgtccgatttcacggcagtgattctggcgatatcagcctggaggtctttctgcttcgattgttcctgcacataagacaccctagtggtggtggagtgatttttgggtatcgacgacaggtgaattcatgcacgtttgagtgtcccgtgtgtggggtaatgttgtccaagagagtggaaggaaatgctgtggcggttgaaaggagtgcctttcgtgggttttgatgtggccagggttcgggggctttatacctctttgggcgatggctggacgtaccttaattcacatcaaattccgcaggttccggagcgggtggcgtcgggagttgcggcggctttccgcacgcatgcgcagatttctgaggtgacgtcgcagccgattgcggtggatcagttggaggctgctcgcgaggcagttgcgtcgttggcgggtgtggatccggactgtgttgtgctgggtcccacgaggcagtttttggctcatacattggcgcgcggtttgggtgggtttgtacgtcgaaaagcgggcgtggtgttgtcgcgcgcggacgcggactggctgaccgcgccgttccgctccctcgacggcgtttttagctgggccgagcccgatttgggcaccggcatgctgccggattggcagtacgagaagcttgttgacggctcgacgcgccttgtcgtgctcagcgccgcgcacccgctgctcggcacggtcgccccagtgggcaagattgtggataaagtgcgggcgcgttcgcgtgcctgggtgcttgtcgacgccaccacctacgcagcctaccgccccctgcgcctagacgagtgggaagccgatatcgtcatgcttgatctcggcgagttgggcggcccgcagatttcggcgttgattttccgtgatacctcgatgttcccgcgcctggatcgcaccgttccactcgaactgcccgcaagctccctgccgcatgggctgctcggcggcgtgcccaacctggtgcggcacctgggaaacctggatgaaaacgccccgtccgtcgttgaggcgatgggggagatggcgaaattccacaagggactttttgagcatcttgtggaatcgctcgaaggacttcacgcggtgcatatcgtgggaatttccggcgatgccgcaggtcaagacgccgcgttcctggatcgagtgccccgcttgaccttcaccatggaaggcgtgcccgcagatatggtgtaccgccgattggtggacaatcgtttgatcactaccgtcagccctgctgacccgctgctcgaagcaatgggtgtgactgaagctggcggatcgatcactatcggactaagcccgtttagcacctactatgaagtggatcagctgaccagggtgctggcatcgcttgcctaaaccgcaagcacgagcttgccggtgatggtgccgtcttgaattttctgcaaggcggcggctgcttcggctagcggcaaggtgtggtcgatgtgaggggtaatttccttcgattgcagcagcggccaaatattttcgacagtgctgctgacaatccgagccttatccgcctcatcgcgaccacgcagcgcagtggcagaaatcgtgcctcgcttggccaaaagatgacccaaattcagctcccctttcacgccaccctgcatcccgatgactaccatgtgcgcgtccttggccatcgccttcacattctgtgacaaatacttcgcaccaataatatcgagaatgacatccgccttgttcttcaaaacctcggcgaaatcttcctccttgtaattgatgaggatatcggcccctaagttcttacaggtttttaacttttcagttgaaccggcagtcaccgcaaccgtcacacccagagccttgcccatctgaatggcaaacgttccgataccgcccgcgccaccatgaataaggaaagtatcctccttctgcaagcccgccagcatgccgatattcgaccacaccgtgcacgcaacctccacgatcgaggccgcttccacaaagctgtaaccctctggaattggcatcaactgaccttccggaaccgccacatattgcgcatatccaccgccagtgagaaggcaagcgacttcctgacccactgtttgcccagtgtcgccggcatccacgatcacacccgcacattccagcccgagaatctccgaagcccccgccggcacaggataatttccctgcgtctgcaaaagatccgcacggttaacgcccgcagccttcacctccaccagcacctcacctggcttcagggtcgggacggggacttcctgtaattccagagaagcagtgaccttctcctcagtttggacgatggcttgcatggtttggcgcgtggttttagtcatgcattcgagggtagccggttattccagatcgttgcgccgattgacgtcagagttgccaccacatttagccccgcaccaacaccaacaatgaccatcactaagccaaacgccgacaatccggtttcatcctgaggaatggcatccatggcccacgcgaaactaaaccccgacgcaccacccaacgccgaataaaacggaccagacgcagtccacctagtccacagaccaagaatcacagtgaccgcgaccatcgtgacaccacaagcaacaacctgccacggacgatacggaccttgcatctgcccaaactcattctcgtaataaccaccccaactcaaccacacaaaccacacgatgagccccgcaacaaaaccaagcaacaaccccaacccaatacccggacgacgaccagaccgcggcacttccttagccaacttgtgcaccgcaaacacaatgaggaaaaccaccagaaccggcacaccaatcatggctgcagcgatgatggcgatctttaacacatccatgtaattccccctgattaggtgatttagtatgttcgagactatcgggtatgatttcaacttgtcgcaaatatcaatttttgatgtttgagtcgctggagacgtgacagagcggccgaatgtactggtcttgaaaaccagcgatgggaaaccatccgagggttcaaatccctccgtctccgcaaatagcccccgtttacgcaggtaaacgggggttttctgattcttgggcggtcggggctttatccgaaagcactgttgcctaaactagggcacatggccctgcacacgcacaagatagacggcgagacctacgctttttcgtggtcacccacgcaaacgcttctcgacgccctcctccaggccgacctacccgcccgctattcctgcatggaaggccactgcggaacttgccaatgtacgctgacgggagggccctcgcacatgctcaacaatgaagtactgagcaactacgagatcgtctccgaaaaccaagtgttggcctgccagacaatccgagacgctgacgggccataccactgttccttcgatgactagctcttcttgatcacttccatcgcttcgtgatagttggatgtagctgcatctttgccgttccagcacgcaatattacgaacctctggcatcatgtcgcggtggaacacaggatccagaccagccttcttctgaatggtgtaattcttaagcaacttcactgcaacgccacccagcggaatgatcgccgccaggttaatgagcaccatgatgccagcgaaagtatcacccaaagcccagatcaacggcaccgaagcaaccgcgccagagaacacgctgagcagcaccaagagtcggaaaacagtcatgacagtcttcgaatcggtgaagtactgaatattcgcctgtgccaagtagtagttacccagcacggaagaaaacgccaggaagaacatcactacggtaatgaagtgggttccccaaccaccaacaacgctagccagcgcggactgagtcaaagaagaagactgaatatcgccggtcgcgtactccactccagacagcaggatgacaaaagcggtaatgctacaaacgagcagggtgtcgaaatatacgcccagagtctgaaccaaaccctgcttcacagggtgagacacagtcgcggtagcagcagcgttcgggacagaaccctcaccagcctcattggagaacagtccacggcgcataccgttcataaacgccaaccagaacgcgccccacaccgacgcagtagcaaccggacggaaaccaaaagcaccagcaatgatgtcgttgatcatggtcggaacctgctgaatgttaatcacaatcaccaccacacccacaatgatgtacgcacccgccatgaacggaaccatccactgcgtcacgtttgcgatacgctgcacgccgccaaaaataaccagcgcagacaatccagccatgcccaagccaacaaaagcctttgcagtggtagaaggggtgccgagtgataccgtaatcgcctcaacaaccgcgttggactgcaaagcgttgtacacaaaaccaaaggtcaacgtgatggcgacaccgaaaacaaccgcaagccaccgagcattcaaaccaagcgtcatgtagtacgcagggccaccgcgatagctgtcgccgtccttcaccttccacaactgtccaagagtcgactcaatgaacgatgtcgcaccgccaaccagcgcaatgatccacatccagaacactgcacccggtccacccagagtgatcgccagcgcaacacccgcaacattcgccgtaccaactcgcgacgccgcagaaatcgtgaacgccttaaaagccgaaatgtcctgcttgtccgcgaactccccatccttcgcaggcttctcgacgaccgctttgaacatctccggaatcatccgaatctgaaccagcaacgtacgcccaccgaaatagaggccagcagcaacgagcaagaagggcaagatcatccacaaattgtcattaatgacatcagtgatgaaggtctccaataattccatgcgaaaaatactacgcgcgtgttacccgatttttagtaaatccctagccactggcactggattgttatagcccggaggtgtaaagcaaggcagattagctccctgggtgggcggctccggaggggagtctgcccggcttcgcccgctgtggtgcaaacagggcgggtttcagctcgggatggtcgcttcgacgcgcgagcttgccttgttgtgtgcgcggcgggtcaatcaaggcaggcttcggcctgggatagcccttcccgtcgaggaacccgccctgttttgcccgggcgggaatccacgcgcgcgaaaccgggcggattagcctcccgaatggctgcattcgccgacaagttcgccttgttttgcacggagcggggacagcctgctcgaattcaggcgggttagcttcacagacggccggtttcgccgatgagtccgccccgttgtgcacacggcgggtcaaacaaggcaggctttggcccgggacagcccctcctgctgaggaactcgccctgttttacacacgcggcgaacgaaacacggcgaactagcccgccaaatggcacccccggctgggaaactcgccttgttttgcaccaacagggaacctggagcgcagtttcggggtctaagtaggtatgggagaaaaacggcggatgtggacggcgaaggaactgatcgggatggggtattcgcggcggaggatcaacagtttggtgaaggaggggaagttacaccgggtgttgaggggtgtgtatgcgttggatccgccgtcgggggaggttgtgtggtcggcgattcgcctggtcaggccgggtgctctgttggatgggaagtcggcggtggaggtttatcagggggtgtcgttgtcgttgcctgtgcgggtgagggtgagtacgtcgaatgtgttgagggggtcgcggaatgtggtggcgcggaggtctcagaggatggatgggattgctcatcgggggtttagggtggtgtcgttggtggatacggttgcgacgtgtcttgatgagcggagtgtgaatccttctgacctgcggagattagtggaggagaggtataagtcggggagcggggtgaagcagatggcgcatgatctgaagttgttgagaacgcggaggaaggcgcagctgcgggagtttttggaggagtgtatctatggtttggacagtggtctggagaaggtgatggtgcaggagctgcgggatgctgggtttcggaccaggcagaatgtggtggtggaggggtatcggtgggatattcaggtggtgggtgtggcgctgattgatgtggatagcaggaagtatcaccaggcgaataggcggaatttcatcattgatcgctggaagagcaatgaagccgtggtacaaggccatgtgccgttgaggtttacggatgattgtgtgaattatgcgacgggggagatcattaagttggtgaaacaggtggcggagttcaaacggaagcatccgcggaggagggtgaaaacgcaaggcgttgggccggtgtttaggtggcacaacgccttggttttaccctagggaatctagccagccttcgattccgccgtcgaggctgctcattccggtgtagcctgcggattctaaaattgcgatggcttgtgcggagcggacaccagctgcgcagtagacgataacctctttacctgcggaaacggagggtgggatggcgccttcgcggatggcggacagtggggtgttgtgcgcgccggggatggagtaggcggagaattcggagggttcgcggacgtcgatgagcgaaacgccgtcaaccagcgcggaaactcgaggaacatcgagcacctcaccaaaaccgccagaaatccccgaaacaccagcagacccaagcacccgttccagcacctccggcgaaccgacgacggggatgtattcccaggtgccgtcgagggaggagtagtagccgagttttccgatcaagggtgtgcccacgccggtgatgattttcagggcttccatggccatcgcggagcccattacgccgacaactggacccaaaacgcctgcttgggaacatgatgggacggatccgggtggtggcggggtggggaagaggtcttcgtagatggggccgtggccggcgtggaagacggagagttgggcgtcgaaacccaggatggatgcccagacgtgggggatgccaagttttgcggcggcccaggatgcgaggtgtcgggtgtcgaagttatcggagccatccaaaatcacatcggaatctgccagctcagaaagtgcatttgaccagtccagtcgcctgacagaaaccgtcactttaacggaagggttcagtgccagcattgcttcgcgcgcggactcggccttgggtgttccaacgccagcggtggtgtgaatgacctggcggtggaggttggagaggtcgacgaggtcatcgtcaatgatgtggatgtggccgacgccagcgccagcaaggtagagcagggcgggtgacccgaggccgcctgcgccgatgacggagaccttagcgtcgaaaagcgattgttgtttttgctggccgatttcgccgagcataatttggcggcggtagcgggcgatgtcgaggtttttcacaggccgacccaatcggtggagccgtcgaggcgcgtttgctctttccagatcgggacctgggctttgacggcgtcggcgaggtcggagcaggcggcgaaggcgtcggcgcggtgggcggaggcggcgacgacgaggaaggcggcgtcaccgattttcaaggcgccggtgcggtgcgcggtccagaggcgggtgcgcgggtgtttttcaacgatggagtccgcgacagcagaaaggacctgcggcgcggtgggatgcgcggtgtaggtcagggaggtcacgcgggcgccgccgtcgtggtcgcggacgatgccttcgaaggtgaccagcgcgcccatcgcctctgtgcagacgccgtttttggcggcgtcgagcagcggttcgagggggtcggtggtgaggaaagcgtcgatgagtttgccggtttgttcggcgacgtaagcggggtcagtgttcatggtggccttgcagagttccagtgatgtgatcaatgagtgggtcgaggacagcggtggcatcgcgcgccgcacccgtggagccgggcagcgccatgatgaaactgccgccgatggtgcccgcgacggtgcgcgacaatactgcggtcgggacggcgtccatgctgtaattccaaaaagcgtgggcgatgccggggatttctttgtcgaggcgcgggattaaagtgtccacggtgatgtcatcaggcgtgagtccggtgccgcctgaaataagtactacctgcggaaattccagctcgtccaggaatgcgggcaggttggcgtccgccacgatcacgggggcgggtgtgtcaaaaccttttgcacgcagccacgacaccaaaattgggccagagcgatcctcatacaccccggcagcggcgcgagtggacgcaacgataaccagagctgtcactgaacagaccaatccccagatttaccgccagttttcgacagcacacgaatgccatcaatcacggccatcttatccacagccttgatcatgtcgtataccgtcagcgccgcagtgctcacggccgtcaacgcctccatttccacaccagtaaccccacgcgttttcaccgaagcctcaatccgaacaccatcagtaagctcaaaaaaatccacagtaattttgcccagcggcaacgggtggcataaagggataatgtccggcgtcttcttcgcacccatgatacccgcaatccgcgccacaggtagcgcgtcgcctttaggcagaccagcactaaaaagctgctttacgacgtcccccctcatcttcacaaacccttcggcaacagcagttctcgatgtttcatttttgcccgtcacatccaccatatgtgcggaaccgtctgctcgaacgtgggtgagctcgctcattaaattaactcctgttagttgaatgggtaaatcttaacgatgtcgttttcctccaccgtagtccgcgccgggatcctgatcagacagtctgcggtggcagcttgaaccagcaggtgggaactggtgcccaggagaggcgtggcgaggacgtggccgttgcggtaactgatggtgccgcgaaggaattgctcgcgattgtcttgcaagccctggaccggagcggtgatgcgggcatcgaggtggcggagcggctggcggttgagcgctggcgcgacgaaaagtgtgaaactcaccaaggtggaaatcggatttccgggaagtgaaatgacaggagtttcagcaaaagtggagatgccttgaggaccgccaggctgctgatcgacatgtccaaaccaggagttcggggtgccttcgaggatctgcctaaacacctcaaatttaccgtggctgataccaccagaggtgatgatgacatccggttgatactggtcaatggcgttttccagttcaaagcggagtcgttcaggatcgtcgttggtgtgcagtcccgcgatgacctcgatattgttgcgggcgcacagggaacgaagcagagggccgttggcatcagggatcgtggcgggtccgtgctgttctgaaatttcagacccgccggtgatgatgaggacacgtggctttgctgcgacttcaatgctcttgatcgactgactagccaacaccccgatgtgcaccgagttaagctccgtacctgctggaatgatctcgtcgccggcagtaatatccgaaccctgcaaccgtatgaactgaccttgcggggtggcggggatttctacctgtggggcgtcgaaatttcccggtgtggttttctccacaggaatgatcgcggcggtgtttttaggaaggcgcgcacccgtcataatcggcgcgatgtctttttcgatgcctcgtgggtaccactgatcaggatcatgaccagcgggaatggttggaccgactgcgaaggtgccaccgttaagatgtgaggggccaagcgcgaagccatccatttgggaattatcaaaacgtggcgaatcccactgcgcagtgaccgctgaaaacgtgcggcgtcccaacgcttcgcgcagattcacgaacgtggacttttgtgggggaagcagcgctgaaatttctgccaaatgttgctccggcgaacgagacatcaattaaacctttctcaccttggaaaacaatcgtaacgctccgatggctccaatgatgaggacatagacagccaaaagcataatcaccgctcccaaggctttatccatgtcattggaactcaaaccaagctcaatatgcaacggaatggtgcgggtaacacctgcaatatttccagcaaaagtcagtgtcgcaccatactcgcccaaggccctggcgaatcccaaaatcataccggtgaaaattccaggcatcgccagcggaatgatcatcttgtgcatgatctcccagcgggttgcgccttcagtagctgcgatttcctcaaactgttttggaatgccacgcagtgcagtagtcacagtggaaatgaaaaatggcaacgctacaaacacctgggcaaacaccacagccgtggtggtaaatgcaatcggcaatccaacctgatcaagccaagaacctaaaaaaccacgcctgccccacagaaaagtcagcgccaaaccagacaccaccggcgacaacaccaaaggcgcataaaccagcaccgtcaaaactgatgtcaccctggggtgcgaacgctcatataaatgcagcgccaacgctagcgggaaacccacaattgcgcatagcgcggtagaaaacagagcagttccgatagataaccgtgcggttcctaaagattccggcgcggtaagcaactcccaagaccgatcccaggggatctgcaacagcaaagcaaaaataggtccaatgatcagcagcatggccagggtggctgggatgagcaaccaccctgggaggatatgattctcgcttcgacgagcctttttagtttgtgccaaaaccatagctggcaaggatctccttggcacgatcgctgctgaggaactctgcgaaagccttcgctacctcgttgtcttcaccggtggtggtcaatgccattgggtattcgttggcgtcgataccttcgagttcaatgacagtgttgtcctgagttttagccaaagactgagcgtcggtttggtaaacaaagcccgcatcaactgcaccggtggaaatcttcgtggcgacatcagcaacattggcttcctcagagctggtgttcaactcgatgtctgcgtagtccaaagcctcgtgggtgatggttccacatggaacttcaggggcgcagatagcaacgagggagtccttgacgtcggcaagctctgaaatttcgccggggttgccgtctgcggtgaccagcaccagcttgttggtagcgatgaccttcgaggttgcgccggcaaattctggaagtgccagcgcatcgtccatgttggcgatgtccgcagaaatgaacagatcagatggtgcgccttcgctgatctggcgaaccagcgcggaagaaccagcgaagttaaactccaactttgcatcaggattgtcttcgttgaacgcagccgcgagatcctcagcaacgttggtcaaagacgccgcagcgaaaacgctagcggttccggaaaccccagctgcttcggtagcagaggcattctgggtggtagtgcttgcggtgtctgaagaagagcacgctacgagtgagatacccgccgaaatagtgatgaaactgtagagagctcgacggatacttttgttcacctgagtgcctttcctacggtaagttcagtacttaatcagcataactgtggggtgggaaactttcagtgggattgggtggaaattaaacgctccttgtttaagtactgcgcctttcctacgattagttcagtacttaatccagagggaagtttcaacaacatggacattcattattttgcggcagctcgggcagctcgtggggtggcgcaggaaactgtggcaccaagtgaacttacactcagcgatctgctgaaacagctcggtgagcagcacactgaaaccaccgcagcgggcatgacgttggcgcaggtgtttgatcgctgcaccttccttatcgatggccgttcggctgattcttccgcctcgctcagcggggcatcacgagtggatgtgctccctccttttgcaggcggctagaaactaaacaccttcttctgggttagcgtgacgctttcgccgacgtcgaatttttcctccgacacggcgtgcccctcggtggtttgtacaagccactcgcggcccaaatacgtcacggcttccacggtcgcagtgccaccgcgggcgagctgggtgtcttcgggtcgccatgcctccacggcgtccccacgccggcgcacattgagctcggtgggggagaggaactcggctatttctagggtttttggcttttcgacgagctcctccgcctcaccaacctgcgcgacttggccatctaccagcacgacaatttggtcggcgagcgcgaatgcctcggatttgctgtgggtgacgtatacaaacgtcagtcccaacgattgttgaattttgcgcagatcggccacaatatcgcgggctaaggcttggtcgaggtgggccatcggttcgtcgaaaaggtaaacctctacgtctctgaccagtgctcgagcaatgccgacgcgctgtttttgcccgccggagagttcggtaattttccggcgggcgaggggagcaatttcgagcatttccaaaacatcactcacccgctttttcaccacctcatctgcagtattggtggctttgagcttgagcggaaatgccacgttttcccacacattaaggtgcggatacaaaggcgaatcctggaaacacagcgcagtgtcacccagcttggcgatcttattcccaatgctcacggtgccttcatcgggtgaatcaaggcctgccagcaaacgcagtaacgtggttttaccgctcccggacggcccgatgatggcggtgatggagcctgaggggacggtcaatgacacatcgttcaaggcgatggcatcgccgaaaaaccttgatacgtgttcaatgctcagatccgccatggttagtccttttttgcaccgaggaggccggtaatggggccaagaacccagttcactaacgccagcacaatcgcaccccagaaggccgcaccgaaggtttcaatgcgtagaccgaaaccgatcaaatctgacacatactccgccagcagcatgattaccgcgttgatgaccagcgagaacagacccaaggtgatgattgtcaacggcaaaccaagcagcttcaagacgggtttcaccgtggcattcaacacgacaatgattgctgccaccgccaggaatgtcagcagattgtcgtgctgaccgtcctgatagagaggtgtggtgggaaaactcagggagatgccgtcgataagcttaataaccacccacaacgccaccgcgcctgctgcggtgcgcaccgcaaaacgccaaagactacccagcattgatggcctcccacgcgcgcagcagcttgtcagtttcctcggcgttggtcaccgaaatgcgcgcaccctcggggaacgcgcgaatcacgatgccgtgctcggccaatttagccgccaactcagcggcgccctcgcccggcagccagacgaaattggcctgcgtcggcgcagcaccaagcgctgacaccacagcatcacgcttttcgacggtttcctccacccgttccatcaactcatcggcagaattcaaactcgcaagcgctgccgcctgagctgctgaattcaccgcgaaaggaatagccaccttattcatcgctgcgatgatctctgcgtttccgaaggcgtaaccaacacgcaagcccgccaggccatacgccttggagaacgtgcgcaaaccaatcacgttgtcgtggcggtggatttcctcagtggcaactggggtgtcgtccgcgcggttgaactcaaaataagcctcatccagcccaacaacgacatcgtttggaaccttttccatgaaattatcaaactgcgcctgggtgatggtggtgcccgaaggattgttggggttgcagatgaaaatgaggcgggtcttatcagtgatcgcggctgccatcgcatcaagatcatgattctgatcagcagtcagcggaatggcaacaggagtggcgcccgcgacctgcgcgaaaattggataagcctcaaagctgcgccatggaaaaatgacctcatcgccctgagcgcacgttgcctgaaccagctgttgacacagcgcagacgagccgcaacctaccgtgacctggtcaaactcaacctctaaatgctctgcaagagcctcacggagctcaaccgcacccatatccgggtaccgattagccccccaagtagcctccgtcaccgcatcaactgctgccgggagaggggaaaaactaacttcattactagataacttcgtagcatcaacaagacgacggccagggacataagtagggatagttgccaaatctgctctaatcatgatttacacagtactagcccctatggacacgcatccgattaagtcatttacctgcaggtttgctgaaatttagcaagagggggtactgtaacatatcggttctatcggccagcccgagcgaactaaggagacgtgccagagcggccgaatgggactcactgctaatgagttgtcctcttaacgggggaccggaggttcaaatcctctcgtctccgctctagcttgatttcggtcaagcgagaaagcgcccgtagctcaacggatagagcatctgactacggatcagaaggttgggggttcgaatccctccgggcgcacaagtaaaaccccaggtaaacacgctgtttgcctggggttttgtcatgcttgtcaagtatttggtgtttgtaatttaggacagggacgcggcgtggaacttaaataagacggaactgattgctgtttgtctgcttctcgaatgccgttgttttagagcaaaaacgatgggggtaaccgtgtcacccggtcttgctaaggtaaaaatcacgggttattttaataggtggaagcggggcatgaaatagggtcctcagcaccaaccgctaaagcccgtgcattaagtacgggcttttgtcgttgtgagggggaattttgcttctgggttatattgacgaagtgggtgaaactggggcattcgtttctcgacaggatcctcgatacaagacatcaccggccttcgggtatgccggcttcttgataccagctgaaaacgctcgggcgtttggttctgaatttacaaaacaaaagcgaatccgtttttccacggaaatagttaatgcacctaatcctgcaaggtgggaagtgaaaggagccgacctctttcgtccggatactccaattgtccgacctgaaaaccttagaatttttggttctctggtagaacgtcttcaaaaactgggtggacatctattttattacgtcgatgaaaaaccaatcgggactccacgacagacgaaactagatcaagtaggacgtgaacgggaagcaatgcgtgagacactcaatcgtctcgcaactcaggcgaatcgcgaagatagaaatctaatggttctggtcgacagcatcaacgaaaagtctaggaaagagcgaatcgctgaaatgtattctcatatcttttctagatcgggagagcatccagaaatgcgttcaatcgttgaacctcccatgcatgttgatagtgcattgtcgtcgaacattcagtttgcggactggattgctgcctatgtttcacgtgctatagataggcaactaattgaagactccagatatcaatggatagcggacgatataagtacgtttaaagtttatggttcattcactttggagtctaaactgcatctcttacggaatcgtccttgtgaagatttcaatacgagcgacatattaaagagaaatcgacctatgtttagttttgatgcagctactgcgattggttctcgcgtgggggttgcgcgggcgatgcaaatcaaggcggcttctgacagggcaaactctcgttagcttttagtgaggataacaagtccttcactttggagttgtggcgtcttatcagcacaactccaaagcgatgagcctgccacagcagttacgcgacctggtaaatacgaatctctggatcagcctgcaatagtggagctagaccaccgacaacatcggccgtgaacagttcgctgacaagataatcttcagcattagctacggtgtcacagccgtggagcacctgcacgtcttcttctcggatgaggagttctttgcttgtagcgccagcaattgagctgaggaatggttgcttgtattcctggtagacgccagctgctgatgggcggccttcgtcattgattttcaaggtgatctctagaaatgctgccatcgtatgactcactttcgtatcaaaaatgcgcttttgggtgctgccgggactgccccggcactcacttcacgttatggcgcagaggaaagtttgagtaggtgattttgatgaatgtgaccataagtaatagttatgatcagctttcggtttcagtgagtaggcgcgcgagtttctctatatcttcggataaatttgttccaggtgaccacactgcttcgtagaagatttccacgtcgaggccttgttcgcggagtggtcaatggggtgctgtaggggagctgagtttagaaagtggaagcattgcagatccgagtccaagtgtggcccactgttcgagtacttggtagctggctgcttcgccggaataggcgtttaatgccaggtcatttgtttcaaacagttgattggtgaaagtggttaaaccgcatgtgtcgggtaccagaatgaacggttcgtgctgagtctcgcgaagttctatggggtcggtgctgtcctgggtggattcgacgataacgactggttcggagtcaatgatgcggtgttcaaaatggggtagtggtttcactgcgggaatgagaattacattaagttcacctgcaagaagtccttcatgtagttctttcatgtttgcttcgcggagtactaggtcgtgtgctgtgggaagctcacgaaccgcggtatatgttcgtgcaaccagttgagggttgataagtggggagattccaactcgaatgctgcgtgcttctgagttaatcaaacggtgcgcttccgcggtgattgcgtcgatttcagtcagcgcgcgttggatcagggggaggatgtggaggccaaaggacgtcggggtgacgccttgagtagatcgatcgaagagttgttcaccgagccgatcttccagtttggcgatgccgttggatagcgcaggttgggtgactccgtattcgcgggctgctgcgctgaatgagtgagtttctgcgacggcctgcgcatagcggagcccttcaaggctgagccgtttggtcataactatatgttatcccccttattcagagtgatggtctaccggagaagtacccagaccaatagcatcgaccaacgatagcgcgctcagaagttctttagtgaaagcagaaccaaatgcccaaatacattgccatgcaggtatccgaatccggtgcaccgttagccgcgaatctcgtgcaacctgctccgttgaaatcgagggaagtccgcgtggaaatcgctgctagtggtgtgtgccatgcagatattggcacggcagcagcatcggggaagcacactgtttttcctgttacccctggtcatgagattgcaggaaccatcgcggaaattggtgaaaacgtatctcggtggacggttggtgatcgcgttgcaatcggttggtttggtggcaattgcggtgactgcgctttttgtcgtgcaggtgatcctgtgcattgcagagagcggaagattcctggcgtttcttatgcgggtggttgggcacagaatattgttgttccagcggaggctcttgctgcgattccagatggcatggacttttacgaggccgccccgatgggctgcgcaggtgtgacaacattcaatgcgttgcgaaacctgaagctggatcccggtgcggctgtcgcggtctttggaatcggcggtttagtgcgcctagctattcagtttgctgcgaaaatgggttatcgaaccatcaccatcgcccgcggtttagagcgtgaggagctagctaggcaacttggcgccaaccactacatcgatagcaatgatctgcaccctggccaggcgttatttgaacttggcggggctgacttgatcttgtctactgcgtccaccacggagcctctttcggagttgtctaccggtctttctattggcgggcagctaaccattatcggagttgatgggggagatatcaccgtttcggcagcccaattgatgatgaaccgtcagatcatcacaggtcacctcactggaagtgcgaatgacacggaacagactatgaaatttgctcatctccatggcgtgaaaccgcttattgaacggatgcctctcgatcaagccaacgaggctattgcacgtatttcagctggtaaaccacgtttccgtattgtcttggagccgaattcataatgccaacagcaagcccaatttatgatgtcgttgtcgtcggagccggcatttctggcctcatcgccacgcaactgttggaccgcgcaggtctaaacatcaaatgcttcgaagcctgctcaagagttggcggccgagcagtgtctgtccaacagtccgatttgttcctggacctcggcgcaacatggttctggctcaacgaaccacttgtgcagcaactcgtcaataatctcggcctcggcacattccctcaggccatcgagggtgatgcgctttttgagacgcttgtcgacgccccgagccgcctgcggggtaaccccatagacgctgcttcaggcaggttccaagcaggggcctcctcgcttgcgctcgggcttgcagcccagctcaagccaggagttttagaactcggggaccccgtccattctctcagtgaggaagatggggaaatcgttgtgaagtcttccaaacagattgtgagggcaaagcacgtcatcattgcggttccaccggcactcgctgccgagttgattggtttcaccctagatttaccagctgacgtgcgaaaagcagcgcatccacaacatatagctgtgatgaattgggcaaaggagaaatacaccttacccacacaagccgcatcggctgggggttttgggcatgagctgttccaacaaccactcggacatgggcgaattcattgggcatcaacggaagttgccactgagtttggtggacaccttgaaggcgcagttcgtgcaggaattcaggctgcgcttcaaacaggatttaatctaaaatcttaaacctcgtattttccctgataggctcagatgcgcctgaaatcgggcttgttgaggggagaggtgtgtgacatgaaagagttggaactgggcgaggcgagggacgtcgctgcaacgttggaagcgatgccgatccaggaggttattgatcaggttgagcgaacttctataactaaaggtgcggtactgctgcgtctgctcagtaaagatcgatcgttgttggtcttcgatgctcttggtccgcgactccaggctgatctcattggtgcttttcaggatgcggaagtgctggattatttcgctgaccttgaccctgatgaccgcgtttcactgcttgatgagctgccggcgtcgatcgctgacgagttgcttcgcagtctcgatccgcaggaaaagcaggtcacggagctggtcttgggttacgcaaaggggtcggttggacgttggatgtcgccccaggttttattgcttttcgacgacatgtccgtcgccgaagtcttagattttgtgcgcaatcatgctgctgaggctgagacgatttatgccttacctattgtgaaccgtgctcgccaagtgatgggcgtggtgtcgttgcgaaagctgttcatcgcagatcccactctaaaagtctcggaaatcatggtgcgtcctgtttcggtgttggcgtccgcggatattgaagaaaccgcccgctggttcctacagttggacctcgttgcgatgcccgttgtggatgaatcgaacatgctcttaggagtgctgaccttcgatgatgcgcaagacatcgtggagcaagccgactctgaggactccgctcgcagtggtggttcggaacctctccagcagccgtatctatccacgccgattcggaaactggtgaagtcccgcatcgtatggcttctggttttggcagtgtcagcaattttgacggttcaagttcttgatattttcgaagccaccttggttgaagccgtggtactggcattgttcattcctttgctcactggtactggcggaaacaccggaaaccaagctgcaacaaccgtgacccgtgcgctcgcattgggtgacgtccgaaaatcagatgtcttccgcgtcttgggcagagaaatccgagtcggcctcatgctcggggcattgttgggtgccgttggatttgtgatcgcatcgcttgtttacggcatgcccgtaggcactgtcatcggtctgacattgttggcggtgtgcacgatggccgcatcagttggcggagtaatgccaattattgccaaggcgatcggagcggacccagcggtgttctctaatccttttatttcaaccttctgtgatgcaacaggtttgatcatctactttgcaattgccaagttggtgctcggaatctaaaagatttttgcttttcgacgtccactcccagtccttaaccgtattggcaagcctgccagcttcggcatttctatgaagtttctctgtcgcggttaatcatcaaatttggagcaaagttcaaaaaattttacttcgcgtaaccattgcacattggggtggggcgggtgtaatgcaagacttagtaatatttacctaccgccaagaaactagtggtcaggccaatcctttaaaaaggtgtgatgattgacgggggaggggctgaacgtgatctttctaccaattcgcactgcgaacgttaatattccctcgttggcttacatggtcattgatgaccgggctgaatatgtgagaaaatccatcccttctttaagcaagggagtgaattacagaaaaggattgttcagcaatgagcacacctgacattaaagaaggctcggcagaatcaccgggcgaagtaatggtcgttggagacaggcgagagtggcgtcgacaagcaaccggcatcattgccggcctcgtcttagccgccctggtctatcttctcttcccctcgaactccgtggaaaccgtcatgcaatccagtggcgtcgatccagaaactgaatacaccaacaacgcgatgcgtcttactgctgcagtcacaatcttgatggcagtgtggtggatgacagaagcaatcccactagcagcaaccgcacttatcccgttggttgcattccctgctttccaggttgtggactttgggaaggcagcagctccgtatgccaaccctacgatcttcctcttcttgggcggctttcttatggcacttggcctgcagaaatggaacctacaccgacgtatggctctagcggtcgtgctagctgttggtactaagccaaagcaattggtcttgggttttatggtggcaactggatttttgtccatgtgggtgtctaacactgcaacggccgtggttatgttaccgatcggtatgtcggtactggcactgaccgctgagactgtgggcggaatgaaaaaccaaaagaaattcgccactggactcatgctgtccattgcttattctgcttccatcggttcactcggcaccttaattggcacgccacccaatgccttgcttgctgcgtatatgtctgaatcgcatgatatccacatcggatttggtcagtggatgattcttggtgtaccaattgctgtcgtcttcaccatcatcgcgtggcttgtgttgaccaccgtgttcaagccagaaatgaaagaaatccctggcggacgtgaactgatcaaacgtgaaatcgctgaaatggggccgtggactgcacctcaggtcacagtgggtgttatttttgcggcagctgcactggcttgggtcttcattccattaactctagattggaccggttcccagctctctatcaatgactccctcattggcatcgctgccggcctgctgatgtttatcgttcccgctaactttaaaaccggcgaacgcattcttgattggcgtactgcaggcgaacttccatgggatgttctcttgctttttggtggcgggctttcactttctgcgatgtttaccagcacgggactttccctatggatcggtgaactagctaagggacttgatgcccttccaatcttcattctcatcttcgccattgctgtcctggtgttgttcctgaccgagttcacctccaacaccgcaacagcggcaaccttcctgccaatcatgggtggcgtcgccgtaggtatcggactgaccgcaggtggcgagcagaatgttctgctgctgaccatcccagtcgcactgtccgcaacctgtgcgttcatgcttccagtggcaacgcctccaaacgcgattgcattcggctccggctacattaagatcggcgaaatggtcaagggtggtctgtggctgaacatcatcgcagtcatcctcattacgattttcacctacttcgtagcgatcccactctttggcatcatgctttaaaagttaacaggcccgcagtcaacgtaaatggcgttgaactgcgggtttgttgttctttctgaagctgtgtaaagtaatcgtcgttgcagagaacgccacacggtaaacaatctgcactgcgcccgtagctcaacggatagagcatctgactacggatcagaaggttgggggttcgaatccctccgggcgcacagtttaaaaccccaggttgattaaaaagtcagcctggggttttcgcgtgcgccggtgtgtactttgtgcacgttcgacaccaagattttggcaaaatggtggccaaaattaagaaatcttggtgtcgaattcacattaggaatcgcctgagaatcatcagccgataaaactagaacacttcgatccgtgcgccgagggtttcagcgtggatgagctgcttctcccagtttggtgtgcccgggtggagacggagcactggcctggatgaggtgatggtagggctaacggattctttggcgcgtcgctggccggagcgggcttcgtagcggatgcgggatcggtagccgttgtcggcaagttgctcgatgtttggctgttctgcggtgaggccttcgcgggcttcgtggaggatcgccagtgcttcgtcgagggctttgaccagtgggccggcgttgctttcacacatggcgcggacgagtcctgggtcggtgcctgcaacgcgggtggagtcgcggtagctgccagcggctaaagagagagacagtgcgccaccgttgtcaccgacgatggcgagggtttcagccaggatgtgtgttaaatgagacactcgtgctgctgctgcatcgtgtgggccaactcgggatgggacaacttcagcgcccacggcgagtgccatttggacgacgtctttccagatgctgatccaggtggagttgatgtcggtgccgtcgaaaagctggtcgaaggtgaccacccatactgctcgtttgaacagtccgtccatggatgcgctccagccggagttggcggtgcctgccatggggtgggatcccacataacggtgttgcatgttgcgggcttttactgcgtcgtagacggcggtttttacggatacgacgtcggtgaagccgttgtttggtgcgtgggtgtggacggcgtcgagaagcgaatcgattgcggtcatggggaccgcgaggacgatgagcgcatcttcggcggctgcacgctggagggttgcttcaagatcggcggaaacgtcgaagccttcgtcgacggctgatttagcgccggagcgtgagcggttgtagccgaagacggagtggttggctgcatggaggtcgcggaggagggatccgccgatgaggccgaggcccaggatgcatactgggcgggaaatgtctttggtagtcacctgacaagtgtggcacatacctactacggttatctctatgaacactgaagaggatggcctgagctttgcagttacggctaccttagttgaaggtaaatggcaggtacgcgagtttgaggatcacttctccaagctctctacctctattaatgcggttcgctcgctgcgtagcgaggggccggcgtttgcgctgttgtgcgttgatgatgaatattttgtgatggtgcgtcccaccccaagtagggtattccttttcctttcggatgcgccgatggctgtcgacgatgatttcgccgccgcggtgatggatgaactcgatgcggatcttccagatatcaaccctgatgatttggacgacatcgatccatggccagaaggtgatttcgatattttggcggatttggggctgtctgaggaggttctttccgtgatttgcgatgacatggatttggatccttccgaacaattgctgcgcatcgcggaagaactcggttttgataatgatctggctcgggtggtgggattcgactagtgggcgttttacctgtgcaggcgcgcatcaaagacgatgagcgccgcatgcgccatgctttggatattgctcgccaaacccctgagggggacgttcccgttggcgccgtcatttacgcgccgaccggggagatcctggcgaccgcaacgaaccgtcgagaagcagaccgcgatcccacggcccacgccgaaattattgctttacgacgagccgcccgccgtttttccgacggctggcggctgagtgactgcaccgcggtggtcaccttggagccctgcagtatgtgcgccggcgccttggtgggtgctcgaatcggacgcatcgtattcggagcatttgagccccgaaccggcgcctgtggatctgtatttgacgtggttcgagaccccgcggtgttgcacaaagtggaagtcagtggaggaatcctcgagcctgaatgtgctgccttgatgaccgaatttttcgaacttcacaggtaacggatttatatcaatttcagggcgtggcgagcttttagtgattcacgctcctacggtgggtatcacaaatacctcaactagaagtaggagatgagcaccacatgagcgatttttccaacaaggcagaggacctcacaggtaaggctaaagaaggattcggcgaggcaactgataacgagtccctcgctgatgagggccgtgcggatcaggctaaggcagacatcaaggatgctgtcgaaaacgccggtgaaaaggtaaaggacgcagctaacaaggttctgggtgcgttcaagaaggacgactaatcccgtacttgttcaggattagaagccgaactctggatttgtttggcgcgcaaccattccgatagactgatcggcggtggcgtgtccgagcggccgaaggtgttcgcctcgaaagcgaatgttgggtaatccccaaccgggggttcaaatccccccgccaccgccagtgtaagaaccggctcttaagcagtttgtagctgcttaagagccggtttttttgcattcttaaccaataagtgcggatgaattgctctactctgtggtcatgaaccttgcacttttctttgcaattgctgtgaccgctttggtcggtgtttctttgctgcggaagcaagcctcagaggagcgggtgtttccgtggttttgggtgttctttccgttgacgctcatgtcgatttccggaattttgatgaagcctgagtcgcggacttctttcgatttcggatggtcaatgtatgagccgtccatttactccaacgaattccagccagatttcttcgatctctttaattcctccacaatttctttagtcacttatgttgtcacgctgcttgtgggagtaattggttctgtgatcgcgtggaagaagcgtcggatctaggagattttctcggattcacagctaccgcaggtaagttagtggggcgtgaaaaaatagctcatttaagaggagaagcaaccccgtggcgaaattgctattcaggttggggcgatggtcctataatcgcaagtggattgtgatttcggcatggctacttattttggccattgttggtggtctggccctgacgatgcagaaggggttcagtaactctttcactattgaagacaccccttcgattgatgccactgtttctctggttgaaaatttccctgatcagacgaacccggtgacggccgccggagttaacgtggttttccaatccccggaaggaaccacgcttgatgatcctcagatgatgactgcgatggatgcagtcgttgattacattgaggacaatttgcctgattttggtgggggagagcgcttcggcaatcctgttgaggtgtctcctgcgttggaagagatggtcatcgagcagatgaccagcatggggcttcctgaggaaaccgctgcaaaggatgctgccaatctggcggtgttgagcgaagacaaaaccattggctacacctctttcaacattgatgttgaggccgcagaatatgtggagcaaaaacaccgcgatgtgatcaacgaagcgatgcaaatcggtgaagatttaggtgtccgggtggaagccggtggacctgctttcggtgatccaattcagattgaaaccaccagtgagatcatcggtattggcatcgcgttcatcgtgttgattttcacctttggttctttgattgctgcaggcttgcctttgattaccgcggtgatcggcgtgggcattggtgcgctggcaattgtgctggccacggcgtttactgatctcaacaatgtgactccagtgctcgcagtgatgattggcctggccgtgggcattgactacgcgctgtttattttgtctaggtaccgtgcggagtataagcgcatgccacgtgccgatgctgccggaatggcggtgggcacagctggtagtgcggtggtgtttgctggcgcgacggtgattatcgcgctggtagccctcatcattgcggatatcggattcctcacggccatgggtatttctgcggcgtttacggtgttcgtggctgtgctcattgcgttgacgtttatcccggcgctgttgggtgtgtttggtggtcatgcgttcaagggcaagatccctggaattggtggaaacccaacgccaaagcagacgtgggagcaagcgcttaatcgtcgttccaagggtcgctcatgggtcaagcttgtacagaaagcaccgggtcttgtggtggcagtggtggtcttgggtcttggtgccttgaccattcctgcaatgaacctgcagttgtcactgccttctgactccacctccaatattgataccactcagcgtcagtcggctgatttgatggcagagggctttggcgcgggcgttaatgcgccgttcttggtcatcgtcgatacgcatgaggtcaatgctgattccaccgcattgcagccactgattgaggcacaggagcctgaagagggcgagttcgatcgggagcaggcggctcgttttgctacctatatgtatgtcacccagacctacaattccaacatcgatgtgaagaatgcgcagatcatcagcgtcaatgatgatttcactgcggcgcagattctcgtgactccatacaccggacctgcggataaagagacccctgagttgatgcacgtgctgcgtgcgcaggaagctcagattgaggatgttacgggaactgaactgggtaccactgggtttacggcggttcagttggacattactgagcagctggaagacgcaatgccggtttacctcgctgtggttgttggtttggctattttcctcctcattctggtgttccgttccctgcttgttccgctggttgctggccttggcttcttgttgtctgtgggtgcggccttcggtgcgacggtgttggtctggcaggagggcttcggtggctttgtgaacacccctggtccgctgatttccttcatgccgatcttcctcatcggcgtgaccttcggtttggccatggactatcaggtgttccttgtgactcgcatgcgcgagcactacacccaccacaatggcaagggacagcctggttccaagtacaccccggttgagcagtcagtgattgaaggcttcacgcagggctcccgcgtggttacagcagcggcactgatcatgattgccgtgttcgtggcgtttattgatcagccgttgccatttattaagatcttcggtttcgcgttgggtgcgggcgtgtttttcgatgctttcttcattcgcatgggtctggtccccgcgtcgatgttcctgatgggcaaggccacgtggtggatgcctaagtggctggatcgaattctgccaagtttggacattgaaggcaccgcactggagaaggaatgggaggagaagcaggctgcacgttagacttggcacctatgtcagatctttcattcaccctcaacaacaagcttgccgatgacgcccccggcaagcatggtcgtacaggtgtaatccacacacctcacggtgatattgccacccctgctttcattcctgtggctaccaaagccacggtgaaaacccttacccctgagcagattcgggagaccggcgcacaggctattttgtccaacgcctaccacctgtatctgcagcctggccccgacatcgtggacgaggctggcggtgtgtctgcctttgagaactggcacggccccacctacaccgactccggcggattccaggtcatgagcctgggctccggctttaaaaaggtgctggccatggacaccaccaacttgacgcgcaacgatatcaaggcggctaaaaaagagcgcatggcgcttgtcgacgaagacggcgtggatttcaaatctgttatcgatggctcaaagcaccgattcaccccagaagtctccatgcagattcagcaccaattgggcgcagacatcatctttgcttttgatgaactgaccaccttggttgatacctatgactaccaggtggaatctgtggaacgtacccgcaggtgggcacagcgctgcctcctggagcatgaacgtttgactcaggaacgtgtggataaaccactgcaatccctatggggagtggtgcagggggcgcagttcgaggatttgcgtcgacaagcagtaaaaggcctgttggacctggatcgccaggccgccgacgaaggccgtcgcggcttcggcggtttcggcatcggtggcgccctagagaaggaaaacctgggcaccatcgtgggctgggtgtgcgatgagctgcccgaggacaagccacgtcacctgctgggcatttccgagccggacgatctgttcgtggctgtcgaagccggtgcggacacctttgactgcgtggcgccgactcgtttgggtcgacgcggcggtgtctacacgcttgatggacgcatgaatttgaccggtgcgcgtttcaagcgtgacttcaagggaatcgatgaggaagtcggcggatacgccagcgagaactactcccgcgcgtacattcatcacctgctcaaagcgaaggaatttttggccggcacgctgtgcaccatgcacaatctgcacttcatgatcaccttggtggataagattcgtgccagcatcgatgatggcacgtactacgaattcaaggaagaattcttaggccggtactacgcgtcgaaggtttcataaccttcgcggcgtttcacccacctaatgactgcgtaggtgatgggcatgaggatgacctctagaagggttttccacacgaagcccaccacaacgtagttgatgaaatccggggcggtggcaataccgatcactggcgctgcgatggcgcaaaacagcagggtatcgacaaattctccgacaacggtggaaccaatcaggcgcgcccacagggacttttcacccgtgcgctttttgatagccaccagaactttggcgttgagcagctgacccacaatatagcccgccagtgatgccacgatgatctgtggaacaaggccgagcgttgcttcgaaagcttcttggccttcccagaaacttgcgccaggcagccagatggaaatgtagaaagacagcgccgcgagcatcgtgatgccaaaaccagtaagaatggcacgacgagtggatttgaagccgtaacattcggctagaacatcgcccaacacatatgagatggggaagaggaagaacgcaccgtctgtcaccaacgggccgatttctacgcccttggttgcggtgatatttgaaattagaaagactgcaacaaacagcgccagcaaaatggggtacaagcttggctgaatgtgaatgaacgtggagtttccggacgcaacgggggttttcttggctgcgccctgcccaggttgaggctgggtttctggggtgtgtgattgattttgcacgtccacaaccatagccagaaaacgtggatgaaaaaactctcatgttggtttcatcgtggtttcatgaggcgggatttaactagagattgttagccaatcggccagacacttcctcctagaaaggtccctcctcatgaccattgctcttgaacacccagtactgcactccacggcgatcgcgttgcctgctcgttttcaggcgagctatacgacgcgtttggtggcggtgggcgtcgataagcgtccttctgatttttggttggaaacagccggcacgccgcaggcgggcgatgtggtgattgcgcgggtgacggcgattaataatcacaagcgggtggagacgccggagtcgcgcaaggccattttgtttgagggggtgttggtgatgttggcgtatgggcaccggtatgcggcggatcagtttttagcgcatgtaccggaggatttggggccatgccatttggtggcggctggtggcatcgcgggaacggtgacggcgctgcacgatcgggtggatgaacccacagagattgaaccgttgggattgctcaccaatgcgcgcggaactgtgaatgtacgggactttgcggcttttgataatcctttgaaagtggaggctcccaacaagcgtgcgcaggtgatcgcggtgctgggaacgtcgatgaactctggaaaatccaccacgcttgcctgcttggtcaatggtttggctgcggcggggcagaaggtggcggctggaaagatcacgggcactggtgctggaaatgaccgcatgatttatcacgatgctggtgctcacagcgttattgatttcaccgactttggctacccaactacgttcaagctgaatttcgcggagattcgtgcgctgagcgtcaacatgattaatgtgctggctgattctggtgcggataccgtgatcgtggaaatcgcggacggaatttatcagggcgaaacctcgcggctgttgcgcgatcaagtgttccaggaagccgtggatcatgtggtgttctccgctgttgatgccttgggcgcgaaggccggtgtgcaggaactgcaggcggcggggcttcatgtggctgcggcctcgggagtgatgacggcttcgccgctggccaccgcggaagctgccgctgtgcttgaagttccagtggtgcccacttttgatctcaccaacccggagatcgtcacagcggtgctaacggatcatgcctagcttatggcgtgctcgtcgcagacttttgctcattgccctaggtgtacttggtgtgctgcaggcactgctggcgatcatggtgtcgttgagcgtagccgccatacttgagggaaaccgagcacttgttggattgctgcttgctaccacgttgggtttgggggtggcgcagtggattcaaaaagtagtggcagaagatctaggccagcattatgtgcatgaggtgcgtcgtgaattggtgggtgctgcgctggtgcctggaaatacggcctcgttgggcgtgactgtcacccgagccagcaatgatctcaccgcggtgcgcaattgggtggctttgggcattgttccgatggtcaccgggctgccgttgattgcgattgtgctggtggcgttgtttatccaagatctccgcacaggcgtggctgttactgtgccactgctcatgtgtgtagccgtgctgccggtggtggcgcggtggactttgaaaagagcacgtgaactacgcaaaaaacgtggacgcatggctgcgcggatcgcagattctgtcatggctggagaattactgcacgcaacaggagcaatagaccgtgagctcaatgcagtcacccgagattccgaccgagtggtgatagctgctgtaagacgttcctgggccaccggttttagccgcgcattgatggccatggcagcctcgcttggcactgtcagcattgtgatttctggccacctggaagtaagtgaggttgcgggaataatgatgcttcttggcgttcttgccactccagttgcagaacttggccgcgtggtggaatatcgccaaaattataaagccgcgacacgcatcctgattccacttctgcaacgaggctcagaatttaaacactcccaacaaaaactacccgggttgcaagcaacagaaggaatccccggtgtctatgtcaaaggtatttccgcccttcctggagaacggatctacctccacggctctgcagatgcgacgagaaaatgggtcacctcgttgtctgcaatggaggaaggcacagatgtaatagtcaacggtcaaaggctttcgcagcttcctttgaaacaacgacgcgccctcatcggaatcgcctcagcacaccaccacttaagccgtggttcagtatcgcgcctggttggtttgcgagtgccggatgccaccgtggaagaaattgagcaagcactggaacaagttggtctgaacaacaccgggaaacaacgcttgaaaaacggcggacacccctggagtacttcgcagatcaacaaactgaaaattgccagcgccacccttcgaaccccaccgcttttggtacttgaaggcatcacccctgaaaacctcctcaactatcccggagtgatcatctccaccgttcaggagaacccatccgaaacatggcggcaagtgaacatctaatctagaaacatggcaggacgatacgcaccatcaccaagcggcgaccttcactttggcaacctccgcacagcactgctggcctggctgttcgcgcgctccgaaggaaaaaaattcctcatgcgggtcgaagacatcgatgaacaacgctcatccaaggaatccgccgaaagccaactcgcagacctatccgccctgggtctcgattgggatggcgacgtcctctaccaatccacacgctacgacgcctaccgcgcagcccttgaaaaactagacacctacgaatgttattgctcgcgccgggacatccaagaagcctcgcgggcaccccatgtggctccgggagtgtatccgggaacgtgtaggggattgaaggaggaggaacgcgtcgaaaagcgtgcaaccttggctgcgcaaaaccggcaccccgccatccgcctgcgcgcgcaggtaacctcgtttgattttcacgaccgacttcgcggcccacaaactggccccgtagacgatttcattctgctccgcggcgggcaggaacccggatgggcatacaacttagctgtcgtcgtcgacgatgcctaccaaggcgttgaccaggtagtccgcggcgacgacctactcgattccgccgcgcgccaagcctacctcggctcgctgctgggcacccccgcgcccgaatacattcacgtgccgctcgtgctcaacgcccacggccagcgcctcgccaaacgcgacggggcagtgacgcttaaagaaatgcttatcgacgcccccctccacaccattttctcccgcctcgcatcatcgctcggctacgaaggggtaaattccgcaccccaattgttggaaattttcgaccccacaaccctcagccgggagccgtttatttactgaggctcagagggaggggtcattccatctggaggagtcatgccgcctggtcctccttgtccaccggggcctccctggcctccacttggcatgttcatggactgattctgttccgtggttggatcaatcggcacatcaatcgaggcaatgaaaccgctggtagcatcaccggtcaggttagccatctgctgatcccaaccatcggagaagacattgtccgactccaacgtgatgttattgaggttggtcaaagaatctccatacacatcaagtgcatacaccgatgctgctgatgcttcatccaaggcaatctgcgacgtcaaaatgttgttcgtggaatccgtgatgctgtctcgatccgggaacacctcgaaatgaatatgcacccaacggcccgcataacaaccagggaaaatggtatcgaacgtgacctggccatacttatcggtaatctgcacaccgcgtaaataggtctcatcttccagctcagagtcgtacatcgaatatcgacccggcgcatcacagtgccacacgtacaccgcagcaccctccattggctgattgttgttgttcatgtccaaaatggtcatagtcaacgtcagaggtacgccctctgccacggtgtcagaatcaatcgacttggtgatgtcctggcgctccacaccggagacctccaacacatccggaccattcgaaccatcgcccgggtacggaccagcagtctccgacttcatctcagtcaaagtctctgctgctgcactggtggttgcagctgcgctgctggacgcgcttgaggtgctcgatgccgcggaagaaccagaaggtgaacaagcagcaagtgccacacctgctccaccaacaccgatgaatcccaaaaccttcctgcgggagaaaacggttcccaggtcaaatcccaaaccctgatcttccaagtcctcggattgattagggaggaccctgccttcaaattgacgcaactgctcagccatggcttttctagcctttcatgttcggacgtttacgctgatagagacatgctaagaaaagattctgaatggttcctgaatgcttactgggtagatttttctagatttttgccaattgacctcttggctgtatggggttgtgggaatttctgtacgtaaggcgcgtgtcctgccatttgagtggggaagttccgaggttgtgctggtttggcataatgaagctttgtttctcaagtcactatttaatttagttggggcgatttaacgggtcgaatgctcgaggagggtatttgtatgggtgctgtgatgttggtagctcaggagcgattctgaagggtcactttcgaagccttcaattgggaattttgggctagattcggcgggccgcatatctaggccaaacggcggttggggattgggacccttggttccaaactgcagtattggcgcgtgaatgcgctcgctgccaggggtttgtgaaccagggggcgataagaacacatgctaactcaagcacttaacagcgacgctacaccaccaaccctctcctgtacagacccatcatcacgcgcaccattaagacgcaccacaccagcaacttcctgaaccaccggctgctccacataccgctgcgggaactgccggtaatgggcatccaacgcctgcacacgcaacctatgagccgccctccaactaccatcaaacaccgactgcggagtatgcccagccacaccagaatgcggatgaaccgtgttgtaatacaccacaaactcctccacccacacccgggcctgatccatcgatgcaaacaccttcggataaaacggccgatacttcaacgtatgaaacaccgactccacaaacgcattatcatcactcacccgcggccgaatcaacgacaacgccacaccatgatccgctaacaaccgccgcaccctcgtcgatgtcatcgccgacccattatccgaatgcaccgtcaccacacccggattatccgctaacacctgcgttaacaactccaccgcggtggaggtattttccgtcggcgcgaccttcgccccaacaatcttgcgggaaaacaaatcaatcgccagatgcaacgcataggtcttaccacgtaccagcgacggcaagaacgtcacatcccaacacaccacctgaccaggctgtgttgcttccaacctcggcttaacccgtggcgttggtgatcgtttccccggggacagggcactgactcggtctttgtgtaacaacttgtgctgcttggcaacacgccaccatgtacgtagtgatgcgcggtagatgcctttgttaaacaacatgttaaacaccccactaacgctcagttgtgggtacgcggtgatcgcatcaacaatgaactggcgttcgtgttctgccaacgcttgacgcaccgacgacactgctggctccttcccctgccaaggctctggtgtgggttccacaccaggtgctgttggtgctggcacggcctgcaggacaggtttcggtgcaggacggggacgcggcttgttgcggtaatacgccgttgatttcgacagcttgatcagccgtaatgccttgttatggctcagcctggcacaggtggtgagatctgtgatcaaggtgttttcttccttgagtccttgatcaaaggcgcgttgctcatccacgtttaggtggcgtcctcctcgtctaagccctcgccaggattgggcctggtcccaatagcttttcccaagatatcgatcaccatttgattctgatggtctttttgcttgtagtgcgcgagttctttcttcagcgctgcgatttctttgaggtactcgttttccatgatcgtggctctttctagttgttgggcaatcatgtggcgtagtcgaacgatttcgaccacggttcgggtggtcatcaacccgatctggcggggtgagatatcagcgtctaagtccccgtcggtcatagcggcgcaccaggccatgatggtgtgcttacggagttggtaaaacgtgaggaattgctggccctgaccgtgtggttgagctaagtatcctatgaccaggtcacgtttgtcatcagccgttagtgtggtgacatcgtcgactggggctgtacttatcgatcatcccgactactggacgagaattaccggcgatggggcaaaccaagtggccgaagagcccctaattgagagattctcggtcatatgggaccgtttccagacctcaaaaccatcccatatgaccgacggcagtgaaattcggcgttcattggtcacctggtttgggcttgcagggtattgcagggactcaccagagaaaagcacacattttgtcccttaaccaccaaagagaatccccaatacatgaaaaaaccagctccccaccgaagtgagaagctggttcagtttgcggaggataggggatttgaacccctgagggattgctcccaacccgcgttccaggcgagcgacataggccgctagtcgaatcctccagctagaacggctgcaacgcatggctgctttgttctggggattagattacacaaaagtcgtttagaaactcaaatccgctcgcagttggcgttttctggggcggttcagctagagttatgcgaaggatcccgtgcggcgtttatcttgtgaactcccccagggcaggaatgcagcaagggtcagcgagctctgacgggtgcgcgggatcccctaaaacgtctagagtagtggcttgaggtcactgctctttttttgtgcccttttttggtccgtctattttgccaccacatgcggaggtacgcagttatgagttcagtttcgctgcaggattttgatgcagagcgaattggtttgttccacgaggacattaagcgcaagtttgatgagctcaagtcaaaaaatctgaagctggatcttactcgcggtaagccttcgtcggagcagttggatttcgctgatgagttgttggcgttgcctggtaagggtgatttcaaggctgcggatggtactgatgtccgtaactatggcgggctggatggcatcgttgatattcgccagatttgggcggatttgctgggtgttcctgtggagcaggtcttggcgggggatgcttcgagcttgaacatcatgtttgatgtgatcagctggtcgtacattttcggtaacaatgattcggttcagccttggtcgaaggaagaaaccgttaagtggatttgccctgttccgggctatgatcgccatttctccatcacggagcgtttcggctttgagatgatttctgtgccaatgaatgaagacggccctgatatggatgctgttgaggaattggtgaagaatccgcaggttaagggcatgtgggttgttccggtgttttctaacccgactggtttcacggtgacagaagacgtcgcaaagcgtctaagcgcaatggaaaccgcagctccggacttccgcgttgtgtgggataatgcctacgccgttcatacgctgaccgatgaattccctgaggttatcgatatcgtcgggcttggtgaggccgctggcaacccgaaccgtttctgggcgttcacttctacttcgaagatcactctcgcgggtgcgggcgtgtcgttcttcctcacctctgcggagaaccgcaagtggtacaccggccatgcgggtatccgtggcattggccctaacaaggtcaatcagttggctcatgcgcgttactttggcgatgctgagggagtgcgcgcggtgatgcgtaagcatgctgcgtcgttggctccgaagttcaacaaggttctggagattctggattctcgccttgctgagtacggtgtcgcgcagtggactgtccctgcgggcggttacttcatttcccttgatgtggttcctggtacggcgtctcgcgtggctgagttggctaaggaagccggcatcgcgttgacgggtgcgggttcttcttacccgctgcgtcaggatccggagaacaaaaatctccgtttggcaccgtcgctgcctccagttgaggaacttgaggttgccatggatggcgtggctacctgtgtgctgttggcagcagcggagcattacgctaactaaaagtgaatacagcggagacagcacattggattaaccgtctgcttcctgggacaccggaattccaccaggttggcgcgtttaaagtggcaggttacacgcttgaggatgaatcaattgcgtgttctgtcaatttcgggcgcgtcaacaccgggctggtcacggaaggcggcgcggaaacggtcgatgtgcgaagtgagattttgagcctggccagggccgacgtgtccgtgcctgggcgcgccgtcggcgctgctgcaacaatgcttctcgacgcctccctctccttcaaatccgccaccgattccagcgtcactcccatgcatgcccaaccgggacagatcttgccgtgcgtaggaattatggcgaatcttccccaagagggtttttctgtggtgcacggaattttggcggatccccgcatttggggcccggagattccgtatgttcgtgaagaagcaggtcaagtaaatgtggaagcacccgacgaggctggcgatctagcccgattgacgttgcctctgcagttgatcctgctcacggaggaagagtttgccatcgctctcaacgagggcagcgacgtcatgttcgaacgaatggcggagcaagaagtcgatcttctggatctgaaacgttaagacggtaggctcaattccgtggctttgtatagcaagtatcgaccggcaagttttggtgaactagttgggcagtcgcaagtgactgaccctctgtccgcagctttggatagcgggcgcatcaaccatgcgtaccttttttcgggtccgcgtggttgtggcaagacgtcgtcggcacgcatccttgcccggtccctcaactgcgtggaaggcccaacttccacgccgtgtggggtgtgtaattcttgcgtagcgctggccccgggtggccctggaacccttgatgtaacagagctcgacgccgcgagtaacaatggtgtcgatgacatgcgtgaactgcgcgaacgcgcgaactacgccccggcggaatctcgctaccgcgtgttcatcattgacgaagcccacatgatcagtacccaaggcttcaacgccttgctgaaaatcgttgaagagccaccagcgcacctgattttcatcttcgccaccaccgagccggacaaaatgatcggtacgatccgttcccgcacgcacaattacccattccgcctgctcaccccaggggatatgcgcaaagtgctgaaaaatgcggtcgatggcgaaggcgtccacgtcgacgattccgtttacccactggtcatccgcgccggcggcggcagcccccgcgacagcctctccatcctcgaccagctcatcgccggctcgggcccggagggcttgacatatgagcgcgccttgccgctgctcggtgtcacaagcttcacgcttatcgacgattcgatccatgcccttgcatctaaagacaacgcaagcatgttcaccacgatcgataacgtcatcgaagaaggcctcgaaccgcgacgcttcacgatcgacctcctcgaccgcctccgcgacttgatggtcctccaagccgtcccagaagcactaaacctcgggcttgtcgacgcccccaccgaccgcgccgacgccctaatcgaacaatccaccctgttcaaaggcaacgagctcgccaacctagcctccatggtgaactccggactcgacgacatgcgtggtgccacctcaccgcgcctccttctggaaatcctctgcgcccgactgctcctggcaagcaataccgtggcaggtccagcggtcagtagttcgactgacgctgcgcctgcagctactccgggtggtctcactggtattgctgctgcccgcgcgaaagcacgggagtatggacagaagaaggcagctccagctcctgcaccaactcctgcgcccgagccagtgcgcgaacagtctcttgcaccaacgcctgaaccaacgccagcggctgaacctacatctcagcccgcgccggaaccggaacccgccagggaaccagtggtggaagtgcgggaggcgagcgtcgaaaagcagcctgcaagcagtgatcccctcgaaaccattcgaagccgctggtcagagctgcgcaacatcgtggaaaaacaaagtgtgcgcacctcaatcatgctgaccgaagcgcgagttttgggactgcgaggcgataccctcgtgctcggtcacagcaccggggcgttggctgcgcgtttgaacgctgctgatcacaacggaattttggtcaaggtgttggctgaggaaactggtctgcagctcaaggtcgaatgcattgtgggcacgaacccagccgaagctggatttaccgcccagcctgctgtgcaaaagagcacgtggaaccccaactacgactccaaaccagccactccaagtgcgcctgcgcagcctcagacgcctaagcaagaatccgtgcccaccgagccagaggagcctgagagttcggctgaaacttcgggatgggggcaaccggtaaaaatcggtgggccagcacctgaggcacagactccaacgcctccgcctgctccggtggttccggctactcctgctgctccggctgcgggtgctgcgaaaccagcgtggaaggaacgcgtcgaacaagccgcggcaaatgcagcgcaacaacgtcagcatcgccagggcagctccgagcccttcgagcggggtgttccgctgccaccagaacctgacctgccaccggacccctatggatacccagctgacgagggtttccccgaacgaaaccaagggttccagcaacagccagcgcctcccgttgagcaaccagctcctgagcctgcgacggagccagttccagcagttgcgcctgagccggaggtcagccagctatctgaagaagagcagctgatccgcgaagcagacgaagagccaggtgaaatggatcgtcgtgatgcgaaaaccatcgcgatggaactgcttgctcaggaactcggcgcgaaacctttgtaagactcgtttgtaagccgagagcgaacctgccaaaagtaaggggcgggttcgcggtgacgtcggtaggatcgagcgaagaaaccaacaaacttcttaggagccattctcatgacccagccagatatgtcccagatcctcgcccaagctcagcagatgcaggctcaactacaggccgctcagcaggaaatcctggcaaccaccgttgtcggaaatgcaggaaacgggctggttaccgtcactatggccggcaacggcgaggtctccgcagtgaccgttgacccaaaggtcgttgaccctgaagatgtcgaaaccctacaggaccttctgctcggtgcattcaaggatgcccataacaaggtcgcaaacgttgctgaagagaagatgggcccactatcccagggcatgggtggcctcttctaattagttgctaaacgcagggccgggttctcgatgaacccggcttttgtcatgtatgcgatactgttccttgtccaatttttagttcagataggtagtgtaagacgtgtttgaaggcccactccaggatctcatcgacgaactttctcgtctccccggcgtcggccccaaaagtgcccaacgcatcgcatttcacctgctcaacgtagatccttccgacattacccgccttcaggaagccctcggaggcgtgcgtgatggcgtccaattctgccgcatctgctgcaacatttcccgcgaagaagtctgtcgcatctgctccgactccggacgtgacggcggaacaatctgtgtcgtcgaagaaccaaaagacatccaagttatcgagcgcaccggcgaattctccggccgctaccacgtcctcggcggcgccctcgacccgctggccaacatcggcccccgcgaactcaacatttccacgctcctgcagcgcatcggcggcgtcctgccagaccgtgagctcgcagattccacgcctgaaaataagcttttcgacgccacccccaccgtccgcgaagtcatcctcgcaacagaccccaacaccgaaggcgaagccaccgcctcatacctcggccgcctcttgaaagacttcccagatctggtaatttcccgcctcgcatccggaatgccactaggcggcgacctcgaattcgtcgacgaactcactctctcccgagcattgagtggccgcctgcagatctagcccctcctttacaggctggcttttgatcgaagtggcccgtttaacggtcgagcttgccctgcttcgcgcgccgggtgtaaacaacaaggcgaactgccgctccgaacggtcagctttgaccactaactcgcctagttatgagccgcggatgttcacaagtgggtgaccttcactcggaaacggtctgttcgacggagaagctcgacttgttttgctcgtggtgaacacaacaaggcgaactgccgctccgaccggtcggcttgaagagctagtctgcctcgatttgctcgcggtgaacacaagtgggcaacttcaccccggaatggtcccttcggtggagaagtttgccttgtttcgcatactggcgatcacaagtagtccagcttcgcctcgaaacgttccattcggcagggaagttcgccttggttggtacgtgcgtgaaaaccgggtcccctcatttcgagtagacccggtttagaaggggctacgccaggcgttcggcgcggaggcggtcgatgacgtcgatgtccaaaggctccaggtctttcagcgcgacacccattgcttttgcgagcatgaggtcggcgagttgggggtttcgggcgagtgcggggccgtgcatgtaggtggcgatgatgctgccttggacggcgccttcggcgaattgttggcgttggtcgtcggtgttttcggaggctgcccagacatcggtgttgccttcgccgcggacgactcggccgagtggttcggcgtcggggccgagcagggtggcgcccatgtggttttcgaagccggtgagtcgttcggtcagctcggcggtgaatccggcgcgggttggtgtcgtttcgacttctccgatggcgcgtttttgtaaagagacggtggtggcgtcgataagcccaaggccgtcgatgacacggccggcggcgcggaaggagtcgccgagtacctggagacctgcgcagactgcgaagatggggcggcctgcggcggctgcggtttggaggccgccgtctttggtgaggtgttcggtggcaaggatctgtgcggtgtcctcgccgccgccgaggcagtagagatcaagggtggaagggacggcgtcgtcgagggtgacgcgctggatttcagcattaatgccacgcatgcgtgcgcgttggcgcaggactagtgcgttgccgtcgtcgccgtaagttccgaggacgtcggggaggatgaggccgatgttgagggtggtcattattgttcggtccctttctccagagcctttttgaggtctcggaatgcggtgtagttggcgaggacttcgatgcggccaggagggcaggctgcgatggcgtcgacggggttggagatgagttcgtggtcgatttcggcgtaggtgaggcggactgccaggtcggtgccgcgctcgccggaggctttgacggagaggttttcgaagtcttcgaagcggacgtcccaaagccaggagaggtcttcgccgtcggcaacctggccattgacgacgatgactaagccatcagctgtgcgatcaaccatggagagggcttcttgccagcctgctgggtttttggcgagcaggaggtggaccttgtgttcaccgacagtgatggtggaatagcgtccagcaacgttgttgacggagttgactgcgggcagtgcggaggaaacgggcacattaaatacggtggaggctgcgattgcttgtgccgcgttgccacggttggcctgacctgggaggttgagatccaaggtgagatcgccggatggtgaatggatggtatcaccgtcaacctcccatgagggggtggggcgtgcgaaggtgcggccgtcgagaagcgtcttttcggcgctccagtggcgtccgtcgtggaggatgcgggattcggtgcgtgggcaggtggcggattcaccttgccagccggtgccggcgccgacccagatgacgttttcggcgtcgaaagccacggaggtaacgaggacgtcgtcgcagttggcgatgacggtcatctcaggtcgagagcgcacggcatcgcgcaggacacgttcgattttgttaatttcgccaacgcggtcgagctggtcgcgggaaaggttgagcagcacgagggcgtcgggcttgaggcgttcgatggcggcgggtacgtgcagctcatcgacttccaagaccacgtgtgaggcgtttcggccagcgagcagcgcagaaatgatgccggcgtccatgttgtcgccgccttcattggtggcgacggtgtaagtgctgcgcatcgcggcggccagcatgcgggtggtggtggacttgccatttgtgcccgtgaccagcactgttgggcggttgttgatgaggttggacatgatgtccgggtctaccttgctggccaccagtccgccgatcatgccaccggatccgcgacctgtggctttggacgcggatgtcgcaacttttgctgagatgatggcggcagcgctgcgtaaacggcgtaggggtgcaggcagtgaaagcttcatgaaaaacgagtctagttaagcaagtggcactagcgcttttcgacgtccactttcttcccttcttttacccttttaacagctgctaagaaggcaacatcggacagcagcggaattcctttacgctgggcatgcatcgctttgccgtcaatgtcgcgggtttgattgcacaccaccactgaggtttgccgggtgagcttctcagaataggacaaatctgcatcgacgcacgcttggataatgatgtccggatccatctcaatttccggcgcgaccacaacttccatcccagcgatcagcgtctttcccggctcatacgtaccagggttgaccagcgttggcgaagcttcctgcgcctgcacccggatgatcgagcgttgcaaaccaaacttatcggcgcgcaaggactggggatcgatttccgccagcggtcctgactgcttcaacgcaccataaagccgtgccacaagcaaagtttcttcgcggcacaactggcggtgcgacacctgcgcgcgttccaccgacgcctccgctgcaggcgcgtcaaggccgagggtgtgtgcgacaccccggatgcgcacgtcgtctaaagcgattgcttgtcgacgcgccgatgcaagcgtatcgacgatcaccagcggctttgggatgtgccccacgcgctgcctgcggcgtccgcgaccaccacggcgatttccacgattgctgttgcgattggcgcgcgcagcatcattcatagcgcgcttggcttcggaaacaataaagccccaacttcgcgcagcattgtggatcaacagggtacgaccatcgatgaggcggtccaagcttttcaaaatctggccgaaacgcttagcgctggcaaattcttcctctgtcacgccatgaaggtggaaggggccaggatcagttttggaatccaacacggcatgaaaagtttccaccggctccaaattaggggacagcgttaccaaatcaatggtgaccatgcgtgaagtcgatgggtggattccacttgattgaatgctgacggaaacaaaaggagccgcctcaatagcttcttggcgctcagcttcgattcttgcggcgtgatcttgtgattccgaagtggtgctcatttttacaactctagttgcttagagaggtttcacagcatttcaaggcatgcaaatggtcgttgatggttgtagatgaccaaatccataggatacccgggcattttcgatcacctggtgaagaaaggtttaaaaactgatggttgcacgcccagcttgcgcaatctaatgggtgaaaagcgccgggactcgttggtaccagacataaggccccagaaagcatgttttttcaagtttttgggtctcatggtttggtcgctctcaaatttcgactttggcctgggtaggttatatcccccagaggtgcttctaatgggttttgagggccttgggcatacgaaaaatcatttgagaaaactcgaggcatgaaacaggctctatattcctatcacccacgaaaccggtggcaagaattttcaacatcgtggaattcttgccaccggtttgtagagcctagggggaggcgtcgtaaagcttaaacgccgccagccaggactgcctcgtggttgacgtccagcgcgcggtttacggcggaggtcactgccttcagcgaagcgtaggtgatggagccagcgatgccgacgccccagaccttgcggccgttgacctcagccagcacgtaggcggctgcttctgcatcgtcgcccgaggtgcgggcgtgctggttgtattcctggatctcaacgtcgatgcccagcttctccagcgcgttggcgtaagcggccagtgggccgttgccgcggccatcgacggtgacgtccttgccgttgtggatgagctcggcggtgatggatgcatcctcgttttcggtctgagcgttctcgacgcgcagcgcgatctgctcaactggtgcggtgcgctccaggtactcggtggcgaagatatcccacattgccttggagttgacctcgccgccctcagcgtcggtgacgttctggacaacggtggagaactcaacctgcatggagcgagggatctgcagaccgtgatcggtcttcatgatgtaagcaacgccgcccttgccggactgggagttcacgcggataacagcctcgtagtcgcgaccgacatcctttggatcgataggcaggtaaggaacctcccattcggtgtcgcgcagctgctcccaagaaacttcagtggagctagcacctggctgaaccttggcagccatggcgtccagacccttgttcacagcgtcctggtgggaaccggagaaagcggtgaagaccaggtcaccgccgtatgggtggcgctcaggaacgcgcagctggttgcagtattcaacggtgctgcggatctggcgtatatcggtgaagtccagctgagggtcaacgccctgggtcagcatgttcagtgccagggtgaccaggcagacgttgccggtgcgctcgccgttgccgaacaggcagccttcgatgcggtcagcgccagccatgtagcccagctcagctgcgccaacgccggtgccacggtcattgtgcgggtgcagggacaggataatggaatcacgacggtttagattgcggtgcatccattcaatggagtctgcgtaaacgttaggggtgatcatctcaacggtggaaggcaggttgatgatcattgggttctcaggagttggatccatgacctcaacaactgcgtccacaacttccttggcgtactcaacctcagtgccggtgaaggactcaggggagtactgccagcgccagttggtgtctgggtaatcctgagcgatggtcttgattagttcagcggcatcggtagccagcttcttcacctgcaccttgtccatgcggaacaccacgttgcgctgcaggatggaggtggagttgtagaagtgcacgataacgttttttgcgccttcgcaagcttcaaaagtacggcgaatcaggtgctcacgagcctgaaccagaacctgaatggtgacatcgtcagggatcatgcccttttcgatgatctcacgaacgaaatcaaaatcagtctgggaagctgaagggaaaccgacctcgatttctttgaagcccatctgaaccagcagctcaaacatgcggcgcttacgctcaggagacatcggatcaatcagagcctggttgccgtcacgcaggtcaacagcacaccactgaggtgcaacggtgatttttttatctggccaagtgcggtccggcagagaaatatcttctacctcaacctcgaaaggcatgtagcggttaactggcattgaggagccacgctgcttattccatgctggctggccttcgttgcgaggcccaactggggtttcgatcttggcaggtgcggagatgaatgcatcgttaggagacattgtgttcaaccttcttaaaaagttttgggtgggtccacgaccggcaacaccaaactccgcgacgggatgccggtcgtgttaagacctctgggacccgccgcggcgaagaagaagtagattcgcacgcgaagtcatgtggtgaagcatacaacaactttgtggtgtgggtagcaactcgggggagttttcttttaaaaaagcttttcgacgcccagttccagtgctgtcatgtctcggggggaactttggagttttaccttttcgatccggccggcattgtgcttgtacgagacagtgcaatggtggaaacaatcatcaccagtagtgcgatgcccatggcgatccattcccagtccacgacttggaatttttcgcccagaaccaagtagcccaaactgaaggcaacaattggttcggcaatggtcatggcgggtagcgatttttgtagttcgccagcgttaaaggaatactgctgcacgattgttccaagtaatgcggtgaggattaggccgtagccttcccagttcaagatgagtcccgttatgccttgatggacaaaaagatccaccgcggctttggacatcactgctacgtagccaaacaatgcacccgtcacaagaccaaggatgagggctttgtccttctttaatacgtattccgcaagcagccacattccacccattactgcaacgccgactaaaagtactggaatccatcgatcgagtggggggtgggggtttccgggaagggggcgtcccaaaacgatcatgatgcccacggctacggtgaggagggtagcccagaagatttcagttcggcgtagtcggtagccattgaatcgtgctgagagcggcagcgtgaacatcagcgacaggacaagcactggttgcactaccaagagggtgccgaaaccaagtgctactgtttgtaagaaatatgccagcatcgcggtactcatgcctgcccaccacatcggtgtcatcagagcattgagtaaaggtgagctccttagggagccatcttttggggtgcggagcgcgatccggtgtctgaccacggtgccccatgcgattgttaatgccgatgctagggcgaaaagcacggcgagcagattgctttgcacttgattcagggtagttgactaaagagttgctcgcgaagtagcacctgtcacttttgtctcaaatattaaatcgaatatcaatatatggtctgtttattggaacgcgtcccagtggctgagacgcatccgctaaagccccaggaaccctgtgcagaaagaaaacactcctctggctaggtagacacagtttataaaggtagagttgagcgggtaactgtcagcacgtagatcgaaaggtgcacaaaggtggccctggtcgtacagaaatatggcggttcctcgcttgagagtgcggaacgcattagaaacgtcgctgaacggatcgttgccaccaagaaggctggaaatgatgtcgtggttgtctgctccgcaatgggagacaccacggatgaacttctagaacttgcagcggcagtgaatcccgttccgccagctcgtgaaatggatatgctcctgactgctggtgagcgtatttctaacgctctcgtcgccatggctattgagtcccttggcgcagaagcccaatctttcacgggctctcaggctggtgtgctcaccaccgagcgccacggaaacgcacgcattgttgatgtcactccaggtcgtgtgcgtgaagcactcgatgagggcaagatctgcattgttgctggtttccagggtgttaataaagaaacccgcgatgtcaccacgttgggtcgtggtggttctgacaccactgcagttgcgttggcagctgctttgaacgctgatgtgtgtgagatttactcggacgttgacggtgtgtataccgctgacccgcgcatcgttcctaatgcacagaagctggaaaagctcagcttcgaagaaatgctggaacttgctgctgttggctccaagattttggtgctgcgcagtgttgaatacgctcgtgcattcaatgtgccacttcgcgtacgctcgtcttatagtaatgatcccggcactttgattgccggctctatggaggatattcctgtggaagaagcagtccttaccggtgtcgcaaccgacaagtccgaagccaaagtaaccgttctgggtatttccgataagccaggcgaggctgcgaaggttttccgtgcgttggctgatgcagaaatcaacattgacatggttctgcagaacgtctcttctgtagaagacggcaccaccgacatcaccttcacctgccctcgttccgacggccgccgcgcgatggagatcttgaagaagcttcaggttcagggcaactggaccaatgtgctttacgacgaccaggtcggcaaagtctccctcgtgggtgctggcatgaagtctcacccaggtgttaccgcagagttcatggaagctctgcgcgatgtcaacgtgaacatcgaattgatttccacctctgagattcgtatttccgtgctgatccgtgaagatgatctggatgctgctgcacgtgcattgcatgagcagttccagctgggcggcgaagacgaagccgtcgtttatgcaggcaccggacgctaaagttttaaaggagtagttttacaatgaccaccatcgcagttgttggtgcaaccggccaggtcggccaggttatgcgcacccttttggaagagcgcaatttcccagctgacactgttcgtttctttgcttccccacgttccgcaggccgtaagattgaattccgtggcacggaaatcgaggtagaagacattactcaggcaaccgaggagtccctcaaggacatcgacgttgcgttgttctccgctggaggcaccgcttccaagcagtacgctccactgttcgctgctgcaggcgcgactgttgtggataactcttctgcttggcgcaaggacgacgaggttccactaatcgtctctgaggtgaacccttccgacaaggattccctggtcaagggcattattgcgaaccctaactgcaccaccatggctgcgatgccagtgctgaagccacttcacgatgccgctggtcttgtaaagcttcacgtttcctcttaccaggctgtttccggttctggtcttgcaggtgtggaaaccttggcaaagcaggttgctgcagttggagaccacaacgttgagttcgtccatgatggacaggctgctgacgcaggcgatgtcggaccttatgtttcaccaatcgcttacaacgtgctgccattcgccggaaacctcgtcgatgacggcaccttcgaaaccgatgaagagcagaagctgcgcaacgaatcccgcaagattctcggtctcccagacctcaaggtctcaggcacctgcgtccgcgtgccggttttcaccggccacacgctgaccattcacgccgaattcgacaaggcaatcaccgtggaccaggcgcaggagatcttgggtgccgcttcaggcgtcaagcttgtcgacgtcccaaccccacttgcagctgccggcattgacgaatccctcgttggacgcatccgtcaggactccactgtcgacgataaccgcggtctggttctcgtcgtatctggcgacaacctccgcaagggtgctgcgctaaacaccatccagatcgctgagctgctggttaagtaaaaacccgccattaaaaactccgcttgagtgctacactttaagcggggttttaatgtttgaggggcgatgggggtcgagcttgtgaagtggaattttccacaagttttaagtttctttagcaggggaaacactgctgatagcactagcgataaagaacatgaaaatgcaacggagctagcggccgaagctttagcggatgtcatttttcagtggaaaaactgggtctaccgacgcgttgatagtgtgcatccatccgaaggagctcgagggagactcagacactccatggattgcgaacctccacctgacccacggcttgcgtacaacgaagttgaacgccgttataacgatattaatgacgtaaagggacaactaatggtcccgctagcgttcattgaaaaaggcccgatgcgtcatcttgatgtctggagaaatgatgggacgagcattcctgtccttggttcggaagaaactggtgaactaatggtggctgtcctcatgctgtttttgaagaaaaatggcatcgagcgaacatctgaacttgaagatgcgatgcgtgcccttgtgatatcaagagaaaagggaaacctagcaaaagcaacgaacctaattgaaagtggggtgtgggagggcaaaacattatgggatagtaatgatcctgcagtgagatttgatgtgggaacaaaagacttgcttttgaatctatctactgattttttgttgatcggtttgttgcccgcggaaacttctggaatcaggcaagttttaaaattttcatatcactgggtggttgaattacctgacagagggcttcttagatcattgtggggtagcgtgtgtgtcgcatttcgagcagctccaatggaaattgaattaccaacacatatgcccacggatgcgaaatcgtaccatcttgaattccacacaccgcctgagttagatactcaagagttatcgcttccagttgattccaagaataagggccatcgggtcggctatccaactgactctagtaggacacctatcgcccatgtgcactcgcatttttccgagataatgaccacaaatgcaaaagtaaaattggaggttcccaaaaggggaatttgggttactgcacttttatcgaatgcactaacagccggaatttttatcctagccttgttgctacccaatgcaactgatgctttgcgtagtgttggaggaaatgcagcggccttgatgcttgcagcgccggcagtatttgtaagctttctcatctttcctaaagaacatatttttgtatcttccatgcttaatccgcttcgtatcgtcgtaggaatatgcgcactactgctctttatgatggcaggaagtcttgtgggtgggttggagcgaccatttcttattcttctgtggtcatttggagctgggttttcattgctagttgttagcgcactagtactaggtccactcctaggaaagttttttgagaggttgcacctgcgccctagtactaagaactgatgtagagtttgtggaaagatgagttagaaatcccaggttgtagacgtcgtgggcgatgcaccattacttttaaataagtaagactcttaaggataaatatgggaaagattagaggaagcgcacctcgaagagctgtcgttcggggcggggttattacttccattgctggaggaaaatcatctgcgagcgtaaaaattaaagattcagttttagataaaaacaaagtgttgatgcggtcaaaggattctagggtgggtaagagtcgctttgatcgagcagcaaaatagaactgtaaattagcaatctggttaagggattacgccgttgacgtagctcatctgctaaccttgggcggatttgccatcttcggctgaggaatcaccggtagctgttgcagcaatgaggtccgctctggcgcgggctacgcgggaacggattgttccgactcggacgtcggcgatttttgcggcttcttcgtaggtgtagcccaacacttgggtgaggatgagggcttcgcggcgttcgggtgggagggcgtcgataagcgtgcgcacgtcgatccactcggaccagatgcctgcgttgctcgcgtcggtggcaccggtgtcttcgtattcgacgatggatttgcgggggcgtgccatgtcgtgtcggatgttgtcgacccagacgcgccgggctagcgatagtagccaggtgcgcgccgaggagcgcgctgcgaagcgggggagggcgctcatgacccgcagataagtttcttgggttagatcgtcggcgatttcgtggccgccaaggtgggcgaggagacgccagacatcgtcttgggtttcccggatgaaatcggtgagagctgcgcggtcgccacggccggcggctagggccagctcggtgacgtgggcgtcgttacgctcttttgacttcacaattgctcagaataccagttcagaccggggtcaccataaaggtgtgtagggggtgtcaaagtgggcaaaaagtatcatacttttgtctttttgctggcagtttacgtaagggctgattatttggtggcgcgaagtgacattctgatgtagactatcaatcagacttaatccataggtaaccctcataaaaggaaggaatgctaatgtctgagaagtcagcagcagaccagatcgtagatcgcggaatgcgtccaaagctttctggaaacactacccgccacaacggagcaccagttccatctgagaacatctccgcaaccgcaggcccacagggtccaaacgttctcaatgacattcacctcattgaaaagctcgcacactttaaccgcgagaacgttccagagcgtatccctcacgcaaagggccacggcgctttcggtgagctgcacatcaccgaggacgtatccgaatacaccaaggcagacctgttccagcctggtaaggtcaccccgctggctgttcgcttctctactgttgctggtgagcagggctccccagatacctggcgcgacgtccacggcttcgctcttcgcttctacaccgaagagggcaactacgacatcgtgggtaacaacaccccaaccttcttccttcgtgacggcatgaagttcccggacttcatccactcacagaagcgtctcaacaagaacggtctgcgcgatgcagacatgcagtgggatttctggacccgcgcacctgaatctgcacaccaggtgacctacctgatgggtgaccgcggtacccctaagacctcccgccaccaggacggcttcggctcccacaccttccagtggattaacgctgaaggtaagccagtttgggttaagtaccacttcaagacccgccagggctgggattgcttcaccgatgcagaagcagcaaaggttgcaggcgagaacgctgactaccagcgcgaagacctctacaacgctattgaaaacggcgacttcccaatctgggacgtcaaggttcagatcatgcctttcgaggatgcagagaactaccgctggaacccattcgacctgaccaagacctggtcccagaaggattacccactgatcccagtcggttacttcatcctgaaccgcaacccacgcaacttcttcgctcagatcgagcagcttgcactggatccaggcaacatcgttcctggcgtcggcctgtccccagaccgcatgctccaggcacgtatcttcgcatacgctgaccagcagcgttaccgcatcggcgctaactaccgcgacctgccagtgaaccgtccaatcaacgaggtcaacacctacagccgcgaaggttccatgcagtacatcttcgacgctgagggcgagccttcctacagccctaaccgctacgacaagggcgcaggctacctggataacggtacggattcctcctccaaccacacctcctacggccaggctgatgacatctacgtcaacccagacccacacggcaccgacctggttcgtgctgcttacgtcaagcaccaggatgatgacgacttcatccagccaggcatcctataccgcgaggtcctggatgagggcgagaaggagcgattggcagacaacatctccaacgcaatgcagggcatctctgaggcaaccgagccacgcgtctacgactactggaacaacgttgatgagaacctcggcgctcgcgtcaaggagctttacctccagaagaaggcttaagtccttctgatttaaaatgagggcctatccaccaatggtggataggccctcattcgactttgaagctattgagaggaaattagctagacagcagatccgcaattcccaaggtcactgcagtggaaccaatggcggtcgagccgagtccaacggcaaagaaaccagcggtgctctgaattgctccttcaacctgcgcagcctgagcagcaggcaggaagctcaacagatcggtggcttcttgtggaagctggatcccagagctgaggttggaggaaccagcagtcgagccagcttcctgtgcgctagcgactccagtgccaccagccagggcggcggtagcgattgcaattgctgcgattgatttcatacgcatgggatcagtccttcactagatgaaaaagattcatgcttcaaaatgcatgcttcacacctgggggcgagctggtttcaccactttcatagcaaaacgtgatgagatctttgcaattcctggcacggtttgaatgtgactggataaaaattgctcatacgcctccaaatcagcaacgccgatgcggacaaaataatctggcgaaccaaaaagcctgtgcaactccagtacttcatcatgctgcgcaacggagctttcaaaattgtctacagtggagcggtcgaagttgctgagagtgacatccacggtcacctcaaatccacgattcatcaccgcagggtgaatgtccgcgctgtagcccaaaatgattccttcggcttccaaacgctgcaccctcctcaagcaaggtcccggagtgagatgcaccttgtcagccagtgcgagatttgagatgcgcgcattcgcgctaagctccgcaataattgcgcgatcaatggaatctagcttcatatattgcacaatagcctagttgaggtgcgcaaactggcaacaaaactacccggcaattgtgtgatgattgtagtgtgcaaaaaacgcaagagattcattcaagcctggaggtgtcgccatccaaggcagccctggaaccagatgataaaggttatcggcgctacgaaatcgcgcaaggtctaaaaacctcccttgctgcaggtttgggcatgtacccgattggtattgcgtttggtctcttggttattcaatacggctacgaatggtgggcagccccactgttttccggcctgattttcgcgggctccaccgaaatgctggtcatcgccctcgttgtgggcgcagcgcccctgggcgccatcgcgctcaccacattgctggtgaacttccgccacgtattctatgcgttttcattcccgctgcatgtggtcaaaaaccccattgcccgtttctattcggttttcgcgcttatcgacgaagcctacgcagtcactgcggccaggcccgcaggctggtcggcgtggcgacttatctcaatgcaaatagcgtttcactcctactgggtattcggcggtctcaccggagtggcgatcgcagagttgattccttttgaaattaagggcctcgagttcgccctttgctctctctttgtcacgctgactttggattcctgccgaacgaaaaagcagatcccttctctgctgctcgcaggtttgagcttcaccattgctcttgtggtaattccaggtcaggccctatttgcggcgctgctgatcttcttgggtctgttgaccatccggtacttcttcttgggaaaggctgctaaatgacaactgatttctcctgtattctccttgttgtcgcagtatgtgcagtcattacttttgcgctccgggcggttccgttcttaatccttaagcccctacgtgaatcacaatttgtgggcaaaatggcgatgtggatgccagcaggaatccttgccattttgaccgcatcaacgtttcgcagcaatgcgatagatctgaagactctaacctttggtctcattgccgttgcgattacagtggtggcgcatcttcttggcggtcgacgcaccttgttgagcgttggcgctggcaccatcgtttttgttggactggtgaatcttttctaaaactgcataaataacaaaaatccgcatgccctcaatttgaaggggatgcggattttttaaggaacctagaaaaggcttaagcagacagcgctgcagaaccaacagctcccagaccaaggaatggaagaacgattggaaggatgattccagcggtactgttcagtgccacagaaccagcggtgctctggatagcggaccctgcatcgccgtaagtcatacctggcacgaagttctgcacggtgtggacgaattcttgagggatctcaatcgtggaactagggctaacctgctgagcattagcaacgcttgcggttccacccctgatcattgcggtggaaagtgcgatagctgcaactgacttgaaacgcattgggactcctaaaaaatattgcatgggaaatatacttgcccctacgaggacaatgtatgaaacttgataattccctgcaatagaatgtgttctatatctatttatttttatccgatttgcaggattgtgcgcaggttggtgaacgtttctggctggacctgatgaaagacggttcgtccttcggggattcttaccaatagaccagcgtcagtcatcttttttaggtggtgggagatggtgggttgacttaatcccatgatttcggtgagttcgttgaccgtagtgggggtgcaaccttctgctgcaagatgggacaggattcttaaacgaactggctcaccgagcactttgaaaatctcggcgtagcgttcggcatcgtccacgctgagtggttctgctgccagtgagcaacactctgcggagttaatgagcggtaggtggatgggtgcggtcatgtccgtcattatatattgacgcacatcgatattgaaggtatttttatatcggcaaacatcaatatgattgaaggctggctcatgacccttactaaagagcattcgacacctcgagcggctggctcaatgtcgtttcttgaccgctggttagctgcctggattttcttggctatggctgctgggttgttaatcggcaaggtctttccaggaattggggcgcttttgagcgcggtggaaattggtggaatttccattccaattgctatcggtttgatcgtcatgatgtatccacctttggccaaggtgcgctacgacaaaactaaagaaatcagcacagaccgcgctctcatggtggtgtcgattatgttgaactggatcgttggaccagcacttatgtttagcctggcgtggctgtttcttccagatcaaccagagcttcgcactgggctaattatcgtgggccttgcgcgctgtatcgcgatggttttggtatggagtgatctcgcttgtggtgaccgggaagcaactgctgtgctggttgcaatcaactcggtgttccagatccttatgttcggtgtgcttggttggttttacctgcagattcttccctcgtggctgggattagacaccacgtcggtgactttctctgtggtatcaatcgtgacttccgttctcgtgttcttgggcataccacttgtagctggagttttatctcgcgtcattggtgaaaaaacaaagggacggcgctggtacgaggacacgttcctgcctaagatttcacccttggcgctgattggcttgctatacacaattgttctgctgttttcgttgcagggggatgaaatcacagcgcagccttggacagtagctcgtcttgcattgccgctgctgatgtactttgtgggcatgtttttcatttccctggtggtatccaaactgtccgggttaacttatgagcgagctgcttccgtgtcttttactgcagcaggaaacaactttgaattagcgattgcggtatcgatcggaacctttggtgcgacatcaccgcaggcattagctggaacgatcggccctttgattgaagtcccagtattagtcggattggtttatgtcatgttgtggcttggaccaaaaatctttaaaaaggagaatgcaggatcatgaaatcagttttgtttgtgtgcgtcggtaatggcggaaaatcacagatggcggcggcgctggcacagaagtatgcatcagattcagtagagatccattctgctggaaccaagcctgcacaggggctaaaccaattgtctgtggaatccatcgctgaggtgggcgctgatatgtcgcaaggaattcccaaagcgatcgatccggagctgctgcgcactgtcgatcgtgtggttattttgggcgatgacgcacaggtagatatgcctgaatctgcacagggcgctcttgagcgttggtcaattgaggaaccggatgctcaaggtatggaacgtatgcgtattgtgcgggatcagatcgataaccgagtccaagctttgctagcgggataattaccgaaaaaggggcatgtcagcaataacttgttggcacgcccctttttttctaaaagcagtttatttggatcgtctgttatccactacggtcacaccatagatggcgcgtcccatgtagtaggaaccaacggaaccgatgacccagacgccgatgatggcgatgatcgctcggatgaaattgttggggttaaatccgtcgacggaccaggtgtgaatcagcagcgcaatgatgagcagcggtatggagacacccacggtggtgccaagcaggttggctcgggtgagcggatccggtgcgcgccacaaagcgattgcagtacctagagaaaacaggcctgcgaggatcacgaggatggagacgatgatctctggaatggtcatttacctgcgtcccttcgaaatgatgcgagccatggacagggttggaagtacgccgccgaggactgctgcgagaagagcaatctcaaaggcgattgaggttgggttgttgagcacccagatgaggtagatcgcgatcatagagtagaaaaccatgtcggaaagcaccacgcgggtgaggaaatctttggtgcgcagaataaggaccagggcagataagagggagaacgcaaacatgcagatgccaactgtggtgacaattccaaaagcagtcatgttgttttaaaactccctcttgtcttggctgacggtgttttgggcggtgtcagcgatctcgcgacttggccactcagcatcgctggggcggatctccttgtaagggccttggcctgggacgccgtggtcaattgaagcgaccgaagggacgaggcgttgttccatatcggcgatggattcaaaaacttctactggatcggaaccaaacactgcttggatcagcaaaatggtggggtcgccgggcttgcggggttcgcgtaggccaagggacagggtggaaggagtcgcggtgatgcacgttgacagggctgcgatctggaagtccgtggtcactcgaagtgggtagcggataacaacggggttgaagccggtgtccttttttaccgcagcggtgatcacgctgaagccagagaggaaaatctggccgatcagccatgggatgaatttcagggcgttaagcattagtttcctccctggtagctagggcttggcactccgatggcattttcaccgagcacagcctgttggtatgcatcggtgttcaagaggccgtcggtggcggtgagggtcgcgtcgataagcgggcccgcgaagatgaacatgcctaccgataaaatgatcaggctgagcgctggggcgatttttgctgggctgatgcgcagctgcggcgagacgccgcgctggtgcattgcgccaccccagaagacttcacgccacacgcggatcatcgagagcagtgcgccgaggctggcgatgatgatggcggcgattgcgatccatgctgcaatattgccgacgcgggcgatctcgagcaggatgagcgctttgccccacataccggaaaacggtgggaaaccgacaacagagaaggcacctgcagcgaacactgctgcgacgacgggttcgcggcgtgcaaggccagacagcttggacaacataccggtgccgtaggtttcttcgattgcgccggaagtgagcaccaatgcggcgatggtgatcatgtggtgcagggtgtacaacagaccagcggcaagtgcgcgctgtggatcgtcagaggtaaacgccatcatgatgagaataaatggcatgccgttgaccatttggtaggcaaggacgcgacggatggagttttcagcaagtccagcgaagccaccgaccagcatggatatcaccatgaatgcgacaatcagccaattccacgtgggatccatgtcaaaaatgtggacccaaatgcgatagagcatgtataccgcgactttggtgtgcaaaccggagaacaaccccatcacagctgctgatgtaccaggataggtgcgtggcagccatgtgtgcactgggaatacaccggctttaaccgcgatggcaataaccacgatgcccattgcgctggcaaccagggggttgccctctacgacatcttgcagagctgcgatgttgactgagcctatgacaccgtagacgattcccacacctgcaaccagcaatgtggaggcagagagattgactagtacgaagattcgtccagaggctaggcgcgcccacgttccggtcatggcgatcaaaccataggaaggcagcagcatcacttcgatgaacacaaagaagttgaacagatcggcagtcagcagagcaccgttgacgcccgtgatcagcatcaatgtgagcgctggatagaaacgcgcgcgggtttcaccgacgatggtggcaaaccagttggcagccaccgcaacgatcgaggtggtgatcaacatgatggcgctgaacgtatcggcagcaaaggggattgccacgccaccgacataaaggcccacgttgtgagcaatcgggccgtgttcagcggtgtgtgcaaacaaccagatgccagcaaaaatacccgcgaaaggcacgatgatgtgcaaaatatcgcggatgagacgccacggcagaagcaccgcaatggcagaggcagcaaggggaactgcaacgaaaataggaaggagaacatccatggccatttaagctttatcctcctgatctgttgggttggtgactgaacgagcgctagtagtcaaaggcgattgatcgtcatctggttcgatggaccgggtgtcgtcgctgcgtcccagtgctgccaaggccaacatgatggttgtggtggccatcgcgatgacgatggcggtgaggacgaaggcctgggggagtggatcggcggcgtcggtaagcggggtcctgtcggggaaggcttcgccgcgccacgtgggcacaccggcgtacaggatggtcaggttcgctgcgtggccgatcagtgacatgccgaagacgatgcgcaccattccgcgttgctgaatgaggtagacacctccaccgaaaagtatcgcgactgtcagtgcgagaatcatcggtttgcctcctctttgttatcgcctgcggggttgatgggttcgggccagtcttcatcgccttctggttcgggttcaaccgttggcgttgctggcagtgggccacttcggcgggcgtagtccagatctgcaatgtcggtacctgggcgcaggtatccgcccaggccgttgattgccatggacaccatgcccaacacggccaggtacacgccgaggtcgaagatcatcgaggtggtccagtgctggcctacgaagttgaagtggatggcgtacaggaaagaaccgtgggtgagtcccagtacgcccgagaacactgccatcaagatgcccgcaccagtgagaatgaaaggaacattcgggcggaaaatgcggccatctttggccttggacaggtacaggagcatcagcgcgccaccggcaattagggctgcgatgaaaccgcctcccggatcattgtgtccacgcatgaacaccatgaagctcaagaagcatagcgctggaaccagcaccttaagcagcatgcgcagcggaatggagttcaactgtgattggccaaaggggcgagggtgggtgcccttggcaaacggatgacgaggcatggaagccaccatcgcaccgatgacgacagctgccatgccaagcacggagagctcgcccaacgtatccagtgcacggaattccacgaggatggtgttcaccacgttggcgccagaggtgatctctggaccttggttgaggtaccacatggccagctcagaacgttcgtgacggccaagcaatccccacaccgccatgaatgcggcgaaggcagcaaggacggcgacaagaacggtgctgcgccttctgctgggcttgatgcgcttgaagttggcaggctggtgccggacaaccatcatgatgattaccacgacgaggccttctaccaggaactgggtaagtgcaacatcgggagcgcccagaagtagcatctggaaggaaacacccacaccaacggtacccacaagcacggctgcgctgaggcggtttcgggtggtgagcaggccgaagacagatagcgcgatgatggcaagcggaatgaggtcgatccaacgatcaattcccggttgctttggtgcaagctgaaccgaggggtgaatggtggcaaaagcagccagcgcccagagcagcacgatgaggctgaccaagtgcctgcgtgggctcatcgaatcagccatgcgaccgaagaatttacccagcaagttggctcggtaaaccagcatcgataggatgtcgttgcctgtggcgatggggaaagggctggtctcggcgattttccacagctctttgcggaacagcacaccaaggattccggccaccagcacacccaaggaaatcaacagtggggtgttgatgccgtgccacaatgccaggtgcatgtgcgccgcttcccccgcggcggaggtggctgcggcggagacgggggcgtcgaaaagcgaaagtactaggactagtggcagagacataagtccaggcagggcggccggaagccagagggagacgggggcttccttgacgtgtgacatgtcgcgtgggccgtcgacgaatgcgccgagcacgagtttcgcggagtatgtgaaggttaggaccgcgccgattgctgcgccgaccagcagtaatacaacataggagttgccgatgggggcgtccatgaacgctgtgatcatgccttctttggacacgaagccgagcaacggcggaaccgatgccatcgacaacgcacctattaatacagacacaaacgtgaacggcatcttcttgaccaggaaaccgaggcgacgaatatcgcgcgtgccagtctggtgatcaatcacgccaatgagcatgaacaacgaggacttaaacagcgcgtggctgagcgtgtgcacaatggcagcgccgagcgcgaaaggagtgcccacgccgatggtcgctacgatccaacccaaatgcgacaccgtggaatatgccgtgagcttcttcagatcggtcttctgcaccgcgaaatacgccgacatgatggccgtacccatgccgacgataatcagcaaccaattccagaccgcaacatcatggaacacaatgctaaagcgcagcaacaggtaaatacccgccttgaccacggccgcagcgtgcaggaacgccgacactggggtggccgcagccatcgcctcaggcagccagaagtggaacgggaactgtgcggacttagtgaacgcggacattgcaatcagcaccgcaataacacccgtgagcactggcttctccgcccagaaatcagagtgcaaaataccatcgaggctggtggtgccagcttgggtcgcagcaatcgccaccgcagtaagcagcgtgaggccgccgaaaaacgtcaaaatcaacgtgcggatcgaaccagattcaccagaagaacccgaacgcgcaatcaacatgaatgacgcaagcgagaccagttcccagccgacgaacaacacaaagacatcatcggcaagcacgagcagcaaaatggcagcggtaaacgccgtcatgatggtgtaaaaactcgtgttgcccttcttccgcggcaaatattccgccgaatacacaaacaccacagcgccgataaccagcgccaacagtgcaaagaacaaactcaacgcatcagcgcgcaaggcaaacttgacgtcgacacccgagccgagaatatccctcacccacgtgatatcccaggtcagcgcctgaccatccaaaattggaccagcctcacgcaccaaaaaatatgcggcgactgcaaagattacagccaaaggccatccagcttttcgatcaatcaccttgaccgaaattggcgccaaaaatactgagatcacagcaagcgccacaacaaatagcaaactcatgcattatccctaatcgcccatagaaccctcgccaccgccaaaacgatttcagtgacacgggagggcatttaccctttaaattgactatttacaaaactacttgatgagttagcaagagcacatttcggtgcgcctccctgctaaacctcgaaacaataactagattgcacactatgtctgccgctgcttctcgatcaagaaacatcttgactgccctcctgctattggtcccgctcatcgcaggtaccatctacgcctccgccatgggcttggacgtctcccgcgcatggtcctcagcagatgaagtaacgggggcacctgcagcctccgtagccaccaacaaccaggagcttatcgaagcccgtcgcgccgccggagaagccggcgcccaagcggggttcctcacctcaggaactgaagagctaaccagcggaacacaagagcttatcgacggcgcagccccactcgaagaaggcgtctcagccgcggctgacggtgcagcgcaactccacgatggcctcatccaactccaggccggcactggacaaatgggaaccggcgccaccgaaattgccgacggcgtccaaaacgcagtcgaacaacttggcggtcttgtcgttgtacagcagcaactcttaggcgccctcaacgaagcagacaaacaactcgcctcgagcaaaatccccgaagccgaagacctgcgcaaacaaatcaccgaagtccgaggacacctcgaaaacttcggcatctccgtagaaatgaccgaccaactcgatcaactacgttccggcacccgcgacctggctaaccaactcgcagtccccggctacggattccacgatggtatttacagcgccaccaatggagcagccgaattatctgcaggtttgcaagagctagaagcaggcgttgggactgccgtcgaaggcttcaccgcactcgatgaaggtgcaaaccgattagactccatggccaccctcaacgaagaaaaaacctccgcagtccaacgagccctcccggtaccccaagtacccgccggcacaatcgaaggcaccgcagacgaagaacgcaccagcgcactagcgcccatgtacgccttcttaatttcagcattggtcatgctggccggtgcagcacttggatgggcaacactaaaaaacaagtggctgatggcctttgctgtcattggtgtcactgcaatcggtggcattatcttgttcaccgtagctttgggcatatccattggagctttgtttggagccttaggaattttgcttcttgccactgttgttgccggtattctctcccggattttgcttgacgtgttgggaactaccggggctattgtggtttctgttctgggatgggtagcccaagctgcagtaattggccatgtatggagtgttaccgctgtatccgatatcgcacttgtttggcgagtcgtcgcaggcatgatgccactgcattatccaacctttgcagtgacctccattggtaatggcggatcagctgcagctatctggatgtctgttgctgtcttgttggcaatgggagcgatcggagctgttgcgcttcggaagccaaaggcggttgcggttgaggttgaagaagctgttgatgctgatgcagaccaagcagcctcggaatcctgatggttttggtctgattcgacctgttctaggcctaaaaagttaaagaaaaagaccaagagccctatgtttttatggtgctcttggtctttttcagtgatgccgttagcccaccgtttgcatgggtaaccttcggcgtcgctgagcctgctttcggcggagagagctattgatctgttgtatcaggttgttccaggaattcggattctgcagagtttttgatgtcacttctaggacatcccatcccgcacttttcagagcattcttccgatgagaatctttctctcgctgctcagaggtgtagtgccatccgccgttgtattcgagggcaacctgccacagcggatctgcgagatctagaaaataggattgaccgtcgtattcaacatgaatctgtgggatgaagccgtggtaacccagtgaatgaagtctgacccgaagtcgtgattcttgcggagattcagcaaaaggattggcgtattgagtgtgtttcttaagttttggctcttgtatgagttcttggaataattcggggcgctgcctgatgagatgatcgatgagagctacttggtcttcaaagtcgttgagagaatgcaggtcgaagacgtcttggatcgcttgaacatcattaacgaacctaatgttgccactgagcagggtgttttctggttcaatccgcctgagaatttcacctcgtgagcagtccctcctgtttagatctccggaaacactgatgattggcatccactgatcgtctaaaagctgatagccacgttgctttaatgctgcatatccgcgaagtactccttctgggcatcttttgagcagtgcttgggtcactaagttgggatcgttgattagatcgttttttagatagacgaagccagtaattttggtgaagagtttgttaaacgttcttcttgaatattcgtgggcaagttctttatatgtgacaggttttttcggttccatactctagttagactgcgatctcgagcaattggttccgaggctctagaagctcgtataaggcgtcgagtttttcgaatgaacgttcccctgggagtgcttgtgttcgtgcttctaacggccacacagcgagttgggatttttgggttccgagctggctttttggtcagattgcggtattaggccaaaagcccttgcgcctttgtactctttggttcaatacgacactttggagggctagaaatgtgaaatctgaaccaaaagacagcgtaggttttaggtttttggtctcgttctgcagttagcgcagccggtagccagatcctcggatggtttcgacccgatgggcaccgattttcttcctcaacgcgcggatatatacgtccaccacgtttgagccggggtcccaatccatgtcccacaccagtcggaggagttggactcgggagaggatttgccctgggtgtcgcatgagggtttcgagcagatcgacttcgcggcgggaaaggtcgtgccaggagccgtcgatgagcacacgctgggtacgaagatcgagctccaaatcgccgtttcgtagcacgcgcgcatcggtcggcgtttcctgaggagtgtgtttggcgaggcggagtttgatgcgggccagtaattctgcgaattggaatggtttgggcatgtaatcgtcggcgccgccctcgagggtgcggaggcggtcctcgatgttggtgcgtgccgtgagcacaatgataggtagcgtgacctgcagatttcttaattgctctaggacatccgtgccgtccatgtgggggaggccgaggtctaaaaccatgagatcgaaatcgccggaatgtgcgcgggcgaaagcttcggcgccggattcggtgacctcgcattcgaagccttcgcggatgaggccacgaacgatgaaatctgcgatgccggcgtcatcttcagcgagcaggatcttgctcatgggtgtattcctttgattgttctggtgcggggatttccaggccgaaaatggatcctagacctggtgtggaattgacgaaagctcggccgccgtgggcttcgccgatcgccttgacaatggataatcccaggccagcgccaccgggacgccgtgaatttttttgggagcctctggagaagcgatcgaacagggcttcttgttcatccatatcaacaccgtttcctttgtcacgaacccaaatgcgaaaaatgcggtcggggccagaccccctgaaatctgaacccaactccaccacatcatcgctgtagcgcaacgcattgccgaacaactccagcactgcctcggtgacccgctgctcgtcgaggctgacgaggccctcggcggcgtcgacaagcaaaattcggtcgctgatggtgcgggctttgtcttcgatatcgattgttaaatccgtgacatccgtggggtgggcgtggatgaaggtgccagaatcggcgactgcgagggtgagcagatcattgaccattcgcgacattcgatccaactcagtggtggccagctcaatcgaccgcgcttgttcctccggcggggtggtggcgagaagctctaactggccacgcaccactgtgatcggggtgcgcagctcgtggccggcatcatcaacgaactggcgctgatcgttatacgcgatttcgatgcgatccaacatggcattaaaagtcctggccagctgcgcaatctcatcacgaccctccacagggacgcgccaggtgagatccgaattactgatctttgcggacacggaactcaatttgcggatcggggcaatgatctggcccgcaatcaaccaagcaatcagaattgaggcaatcaaaccccctgtgccgatcaaaataagaatctggatctggccgttgacctggtctttaagattatcagcgaagaatgcgacaacgaactcaccatcggcctcaccggaagcagtttggaaattcacctttccccagtgagtggttccgcgttcaagatcgctgaaaactccagaattcagcgtggtctgtcggatttccgaaatcaacggatcggagtgttccaaaggaagcggatgggcgccactgagctgggagtaatcaacctgaatgagctctccggggaaaatgccgacaatggcttcattttcatccggaatctgcctcgacaggtaaacctccatcaggcgatgacctgactcaaaaggctgcgcagttgttggatcaattccttcggctgcaaagcgacgaaactcctcaatttcctgctcaactgccgagttcgcggtgttggttacctctgaaagcagcaccgaacgggtaatgatcacaacgctggctagggtcaagaaaacaaccgctgtcatccacaggacaattcgccagcgtagcgatgcaatcaaaggagttgatttagccatgaaatagaaagtgcctcaggggttagttagtcgtcgtcccagtcgtcgtcgaagtcatcatcgtcgtcgtcccagtcatcgtcatagtactgataattgagtggaacttgtggggcttgaggaatttgagcgggggcaggaactgggggttgtactggggattcttgaatttgtgtggttggttcttccggagattctgtagcagggggctcatacgcggaagttgtgggagtggaacgctggttgaccgtggcgggttcactttccacattaggggtagcacgattatttgccagtgcagatcctccgatggcaacgagtacgagcagagccagaatcgtaatcagtggggcgaaacgggggagtgatttcattgggggttctcctttgatcaactcaatctgtattccattgttaggcaccaagatgaaatgaagatgagaattttcactccaagtgcgcgaggttgcggtttggggcggaatcatcaagaaattgccaggattgatcattaatatcggctcattaaggctctttttaatgagagggattcccattgaatgatcagttggtgagttgggtggaaacactcatgacagcatcggtgttttatccggtgctgtcagttgtggtgctcatcgactgcattttgccgcttatccccagtgagactgttcttgctttggcaggggcgtggtcaggagctcggggaactccaaacttgtggttggttatttcagtagcaacgttggccgcgatcattggtgacaacctgtgttatttctttggcacgcggttgatcaatatggtgaacaggattccgggagaatcgaggcgcggaaaagcgctggagtgggcgcggaagaaccttaatgaacgggatgtttcgacaatcattatcgcccgctttattccgtgggctaggtggtttgtcaccatcattttgggatctgtgggatattcctggtcgaggtttatcgtgtgggattccattggagcgctaatttgggcaacccaggcaactttgttgggttatgtgggcggatggcttttccaagaacaaccgttgatcggcctggttgcaggcgcagctttgggaatcttcttcgggttctttttgcagtggctcaacaaaatgtgggagaggcgtcgtctggcgaaagtggctgcagaatgaaaatcaggccagacagtgggaacactatctgacctgggttttaagttgtcgggataacaggattcgaacctgcgaccttaccgtcccgaacggcacgcgctaccaagctgcgccatatcccgagttactggaatcagtacaggaaatcactgtagtcctgtgggtttttcaggtcaaagtgcctgttcagtgatctttattagggtggcgctgggtcggcagaagatgcggaatgggacgaattttgaggtgccgaggccgttggaaacgtgcatccacatgtcgccaaatttgttgaggccggtggcgcgtttgcggtcgattccacagttggtgacaattggcttgctgcccggaagacaaagctgaccgccgtgggtgtggccggagagggaaagctggtagccgtcggcttcgaactgagcgaggactcgaggttctggtgcgtgaagcaacgctatggacagatcagcgtccacgtttggtgcccctgcgatctctgtgtagtcgtcgaggtcatggtgggggtcatcaacacctgagatggcgaggcggacggaacctacttggaattcgagtcgcttttggttggcgtcttgccatccgtgttcgatgaaagcagctcgcatggctcgccaggggaggtcgatgtggctcacttcgcgttttttaccgaagaggtagccgaaaggattgacggggcggggtgcccagtaatcgttggttccgaagacgaacgcgccggggcggttcatcagtgggccgagtgcgcggaggacgtcggggactgctttttcatcgctaaggttgtcaccggtgttgatcaccaaatcggggcttagtgaatcgagtgcggagacccatgcttttttggtttcttggcctgggatcatgtggagatcagagatgtggagaaggcggaattccttctttccacggagcgttccaggcttcaaaattggcagttctactgttttgagctcgaattttttgagctctgagtatccccatgcagcggtggcgataccagctccgagtagggctgcacttgaaaaagtgagtgttttagcgatagttgacaccttattcaccctacctggggagtactctgggcaaacatgagtgaactaaaagacaaaatccgcgcagatctgaccaccgctatgaaggcccgcgacaaggacaccactggtaccttgcgcatgctgctttccgcattgacccaggaagaaacatcgggaaccaagcacgaactcaatgatgaagaagtgttgaaggtgattgctcgtgagattaagaagcgtcgcgagtccgctgaggtgtacaccgaaaatggtcgtcaggaattggctgacgttgagcttaaagaggctgccattttggagggctaccagcctgagcagcttgatgatgatcagctgaacgcgctgatcgatgaggctatcgctgaagtcggcggcgaggccgatatgaagaagatgggccagatcatgaaggctgctaccgctaaggctgctggccgtgcagatggaaaacgactctccaccgcagtgaagagccgtttgagcaactaggtatttctagcggaagaactggttgatggcgtcattgatggcgtcttcaatggttgttccgcggttgtttgttgatggagcaggggtgtctccatcgtcgctgtcatcattgttggtggcagcgggggcagggcttgtgccgtcggagatgtccaaaatgacggttccaccgtcgataagcactgcaccctgaggggttgcgctgactacggtgccgcgcgcgctgccggcgccggagactgaacgcgtggtgaccttgtagcctttggcttcgagggtgcgtcgagcggaggcttcgctttggccgacaacctggttgaggagttcgccggaagtgccgaggcggaatgaatcgctgctggatggcagtgttccttgcgaagctgcggggacgttgcttgccatgttaaaccatgtttgagctggttcgttaccgccgaagaggttaccgctgctgcactggcggacggggccgctgcacagtggggtggtggaggtgccgtcattgtagatgtatggagctgcggcaaagttgctgttgaagcccataaatgctgaggactggttggactcggtggtaccggtcttcgctgcggttggcaaggaccatccgtacatgctggctgcagaggccgcagttccgctgaccgtatccttgctcatgccgacggccaaagctgaagccgtttcggcatcgatggcgcgctcacatgcagggcggtcaatgtagacttcgttgccttcacggtcatggacgctggcgatgggattgggttcgcaccacatgccaccggatgcaatggttgcagcaacattggacaattcaagagggttaacagcggtaggtccaagagtgtaagaaccgaggttgttgtccttcatgtagtccgcgattgagctttcgccgtcgaaggaaccttcatcggtgtagcttcgcaggcccagctttactgaaagatccacaacggtgtccacgccaacctgctcgatcatttcaacgaatgcagtgttgggggactgcgcgagagcgtcctgcagagtcatgcgaggcgcgtaggatcctgcgttttccacgcagtaagtatttgcgggacagttcgcggcaccgccggagcccatgcccttgacctcatatcgagaaggaacatccaacatggtgtctaggccagcgccctgctgaatggctgcagcggcggtaaagatcttgaaaatggaaccggcaccattacccacacgggacgttgcctgaggcagcatcgtttcaccagcatccaggtcaaggccgtagttgcgggaagaagtaatagccaaaatatcgcgggagttctcgccaggctcaatgacgttcacaacttcagcgacacctggggtggttggatcaacgtgggaggacaccgcattgtgcgctgcatcctgaacatctggatccaaagtcaatttgatggtgtaggagtccttcgccagcatatcttgggtgattccctgctcagaaagatattgcagagcgtaatcgcagaagaaaccacgatcgccagcgccgatacaaccattggataagccttgcggggtttccaggacacccaaaggttcctgctggaaagccgaagcctcgtctggggaaatcgcgccagcatcagccatagcgcccaaaacagtattacgacgctcaaacacagcatcgtgattggtgtatggattgagataagacgaagactgcacaatgcccgcgagcatcgcagactgtggaatggttaactcggcagccgacgtaccgaaatacgtccgcgccgcagcctcaacaccataagcaccattaccaaaaggaacaatgttgagataacgagtcagaatctcatccttcgacaacgtcttttccaaatcagacgccatcttcatctcacggagcttacgagggatggaggtttccacagcagcagcctgctccgcctcatcatcagcttccaccaacagcaagaagttcttcacatactgctggttaatcgtcgaagcaccctgctccacgccacccgcagccaggttcgtcaggattgcacgaccaaagccctgcaaatccacaccatcatgctcatagaacctgcgatcctcaatcgaaacgatcgcatccttcatcgacgtagaaatctgatcacccccaacctcaaaccgccgctgcgcataaatataagcaatcggctggtcagtggaatcagtaatcgtcgtgacgcccggcccgcgaccatccgtcagatctgaaaggttggtctgcatcgtgtcattggtacgcgcaaccgcaacgccagaaagactagcgaaaggcacaagtgcgagcgcaccaaggacgccagcggcgactgtagatgcaacgagctttgtcagagaattcgtggtggacactccaacagcctagcgataaccccgggaatcgtgaacccaagactccaacaatgtcagccaatctttatttattcgactgtgcgttactgctgacagtcggcatgctttgggaatccaccaggcaagctataggggactgtagagctgacgttcggaaaacgtgcagaaaaccacgaactgcagtccggaaagcgccccactggcccttcgccggcagccacagaggggttagaccatttattcgcaactgtgcttacacccaagaattctccaacaagaaaaatccctctatcaacattttaagtgaatgaccttaagggtttgcggaatgcgatccatgttccaactcgcctcaagcggtatgtgtgaagcaggtttgaagccagtgatgacctctgatggggttagtttgtggcaatttcggggctggctgaaatgcctaattttccaaaactgaatttaatgagttgagctgtggtaagactagtgaactgcagatatgttggacaattgtaaagtcctctcgttggaggcttggcagtgtggccataaaagtattgcccccgttggtgtgatgcattcgacagcaaattggctgtgtgactacacttgcgagtgtattaagtattaggccgtgcatatgtagcgcattttaaggagattgtcatgacgtctgtgattccagagcagcgcaacaaccccttttatagggacagcgccacaattgcttcctcggaccacacagagcgtggtgagtgggtcactcaggcaaagtgtcgaaatggcgacccagatgcattgtttgttcgtggtgcagcgcaacgccgagcagcagcaatttgccgccactgccctgtagccatgcagtgctgcgccgatgccttagataacaaggtggaattcggagtctggggaggcctgaccgagcgccagcgccgtgcattgcttcgaaagaagccgcacattactaactgggctgaatatttggctcaggggggcgagatcgccggggtttaattaatttcaagggctggccattaacgtggtcggcttttttgattcagggcgcaccccaggcgcaccccaggcgcaccccagcgcaccacaggcgcaccccagcgcaccacaggcgcaccagcccagcacaagagccaacgcaagtgtcaggcacgccagcaaaggggctagcaagaagcacgcccccgaagccttagaaatgcgttccccggtaggatgattgccatgactaaatgggaatacgcaactgtgcctttgattacgcatgcaactaagcagatcctcgatacttggggtgaggacggctgggagttggtctcggtcatgcctggtatgaaccctgagaacctcgttgcttacatgaagcgtgaggtggcttagttcttatggcttctaattccgaacgccttgcagagctgggcatttctcttccttccgttgcagcgcctgttgctgcgtatgttcctgcgattcagaccggtaaccaggtgtggacttctggtcagctgcctttcgttgatggtcagcttccggccaccggcaaggttggcgctgaggtttccgctgaggatgcggagaagttggctcgtgcggctgcgctaaacgctcttgctgcgattgatgcgcttgttggcattgataaggtcactcgcgttttgaagattgttggtttcgtggcgtctgctgatgatttcagtggtcagcctgctgtcgtcaacggtgcttccaatttgatgggtgaggttttcggcgaggctggggcgcatgcgcgttctgctgtgggcgtggcggagttgccgctcaactcgcctgtcgaggtcgaggttatcgtcgagatcgcgcagtagcacgcttttcgacgcaaaatgccggttccgcacttcgtgcgaaaccggcatttttaaattgaccctatcgtccccttagtgttcgtaagtagaaagatcgtggtcttttgattctctggtgattgcgatggcgatgatggacactagggacatcgttgcgaggaagacgatgactggggtgacagaggttccgccgcctggtcccgcgtagaggctagccaggatggttggggtgaatcctgcaccgatgagcgtggccaactggtaacccagggatgcgcctgtgtagcgcgcggaggttccgaattgttcggagataaacgctgctagtgggccgtaaagcatggcgtggagtgcgagcgcgatggtgaatgccgagagcaggatgaaccagttgtctgaggtgagcatccggaagaatgccggcaggtaggccacgaacagtacgagcgcgatgatcatgacgggtcggcgtccgaagaggtcggatacgcgaccgaagaggatcacaaagaagacagagaacactgaggcgactgcgaaggcgtagaggacgctggatctttcgatgccggattgtgttgcgtagctgatggagaaggtggacaagagaacttgaagtccgaatcctgatgcgccgccaagcatggtcaagatcagtgcctttggtcggcgaagaacctgcaagagggggactttacgttcggttggcttggctttttcggcggccgctgcagctgcgaacagtggtgattcgctaactttcgcgcggataaccaagccgacaatcagcagaacgaaagagagcaggaatgggatgcgccaaccccatgaaaggaattgctcctgggtgagaacagcagatgcggtaccgagcgcgaaggttcccagtgcagcgccggttggtgcaccagcgttggtgaaggaggcggcgaatccgcgcttcttggaatctgagtgctcgagcgccatgagggcagctccgccccattcgccaccgacagcgatgccttggcagatgcgcagcatgatcaggattaccgcgcccatgcttccgatcatttcagcgcttgggacaaggccgatgcatgtggatgccacacccatgatgagcatggacaacacaagcatcttcttgcgtccaagacggtcaccgaagtgtccgaagattgctccaccaagtggcctagctaaataacctgcggcgaaggttccgtaggcggcaatggttccagccagcggatcgagattggtaaagaacactgcggggaataccgtcgcggaggctgcggcatataacaggaagtcatagaactcgatcgtggagcccaagtagctggatataatcgcgcgccgggattctgattttctttgcttcgggctgaggttttgtaattcagcgatcggcgaagctgtggaagatgtagtcattgcgttctccaagtgttttcaaagtgacgttggggggtttatgaaacggggatggtgaagtctcgcaggatgttcttttggattttgcctgtggcgttgcgggggagttcttcgatgatgtggatttctcgtggaagtttgtatctggctaggacactgcctagtagttctcgtagttccggtccggttggtgggttggtcaggtagctttctcggatggagacaaaggcgatgccagtttcgccccatcgttcatcggggactccgatgactgcggcatcaaggactgcttccagttcctggagtgcttgttcgacttctgcggggtaaatgttttcgccgccggagatgtacatgtctttgatgcggtctttgatggtgtagtagccgtcttcatctttgatggcgatatctccggagtggtaccagccattttgtagtgcgctggcggtgtcttctggtcggttccagtatccggtcatcacatgtggtccgcggatgagaacttcgccggcctctccggtggggacttcttcgccggttttcgggtccactagtttgatgtcggtgaagaagtgggctcgacctgcggttccaaggtgtgtgcttgtgtctgttgcctcgaggatacaggcgcccggtgcggtttctgtcatgccgaagccttggacaatttttacgtcgcgtccttgccagattcgcagcgcacgttcgctaaggggagagccgcccaccatgatggcgcgaagggaagaaaggtcgcgttcggcaaatgatgggtggttggacaacatgtcgatcatcgctggcaccatgaaggattcggataccttggagcgttcgatttcgtcgaggacgtgctctgcccggaattcgcggtggatgatcacctttccgcccttcatcatcaccgggatggtggtcatgttgaggcccgcgatgtggaataacggcgcagtggataaaagtaccgcgccttgttcaatttcctggctgagcagggcattgaagtagttaaagaagaggtttcggtgggataacatggcgccctttgggcggccagtggttccggaggtgtacatgagcagcgcgatgtcatcatcgctgacttctaggtcgatgtcggcgtcgctcgccgcttcaataagcgcttttcgacgcaaacctggaccctcatcgccttcaacggccaccatgatgatctctggatggagttcttggaggtaagtggcgtgctcgatgaggtcgattccgtaaaacacgatgctcgcaccgctgtcttggatgatgtaatcgatttcgtttgccgataggcgagggttaacaagcacgggtgttgccccaatgaggttcgttgaaaagaacacttctagcagggcagggtggttgaatccgacataagctactcgatcttggtgcgcaacgccgaggtctagaagagcatgtccaagccgattgactcgtttgctgaattctccgtaggtgatgctggtgccttcgaattcgattgcagtggactctggtcgaacagttgccctgcgtcgtgggtagcttcctattccgaggttcactttcattctcctttgtgctttagatcacgtttgaagtcattaaaagcgtaaacgtttaaaaagtcaatcgtttaaaaaacgttctataggaaaattcatcactccacagggtttcgggggtggtgataatcgctcttagctgcacctttgtggatccttgcaataagtttgcccccgatcttcacaattgtgccgatctctaattggcatgaaaaaaccggccatgtgaacatggccggcgtggttaagagacttaaaaggcgattttgagcagcagttcccttagttgttcttgctcgtcggaggtgaggttttttagagattcaccctcggcgatgaggaggcgtttggtggcttcgtcgtgaatttccagacctttttcggtggcgatgatgatcttcgagcgcctatcccgggggtcaacttcccgggccactaatccgcgcttttctaggaaatcgaccaaggcaacaatctgacttgggtctaggtcgagaaatgctcccaattctcgttgggttggttttaatccgctggccgctagggacagtgtggagtattggcgaactttaagtccgaggtcgactaaggcttcgtttcctttggcggatcccttggctcgtgcgcgggcagtgaggaattgaatctgctgggacaattcggcctcgaggaatcgttctggtccgccaatgatctcggcggtggggttgctggtggtcatagtggctccatgtgaactggctgaaaaatagtttcgatcttcaatcatttgaacatgcatgcattctgtgcgtcaagcgaacgatgtaagttttcaaaattaatagttgacattttcaacgttatgagttttcattggtatcacgccccgacgaagtgtctgggatcacaaaccttcaaaggagtttgaaatgtctctcaatggaaaagtcgccatcgttaccggatctggtgcaggacttggtcgttccttcgctcaggagcttgcccgtcagggtgcatctgtcatcgtcaatgacgtaaaccaggcagccgcagatgagactgtcgcagcaatcaccgaagccggcggcaaagccgccgccgttatcgcccccgttggaccctctgaaagcgccgcattgctggtgcgggaggccgtcgacaagttcggttctttggacattcttgtcacaaacgcgggcatccttcgtgataggtccctgctgaagatgacggacgatgatttcgatgcagtcattaacgtgcacctcaagggcactttcacctgtgttcgcgaggcatttggatacttcaaggagaatggaatcgcggggcgcatcgtcacgattggttctcccaccgggcagcgcggcaacttcggacagagcaattacgctgcagctaaggcgggcattgtgggtatggttcgcacgtgggcgctggagatgaagcgcgcaggtgtcaccattaacgcgatcattccggaagcagccaccgatatgaccaagacggtgccatatttccagaaggctgtagaggccgatgagcgtggcgaggccatgccagcattcttccgcgagaccctaggttttggcactcctcaggatgttgcgggacttgtggccttcctttcctctgatgaggcagcgaatatttctggacaggccatcggtgcaggcggcgaccgcatgcaggtgtggaagcacccagagccagcagttactgaatttaacccaggtggctggacctatgaagcactgcaggaacgtggcaagaacattattgagggcaacctgcagtccgtcggtgtcgttttccctgaactgccggcagagcttcagccacaaatcccagtcaaggcataacaccgcacaccaagaattttaggaggggtcatgagcaacaacgtagtgaaatatgagtgcgcggtcgacgccgacaacattgtcgcagtcgatatgcatgtgcacttggaagtcgacagctgcggacacaaatcgatgccggcagacatcatggcggcatcctcgaagtactttaagaccgcggaacgaactccctcagcagatgccattgctgatatttatagggaacacaagatggcggcggtggttttcaccatcgatgcgcggacccaaatggggcatctgccgaactcgattgatgatttggtggcaagctgtgcccgcaacaatgacgtgctgatcccttttggcagtgtggatcctcgtaccggcgaggacgcgctggtggaagctcgccgacaggtggaagaactcggggtgcgaggcttcaaattccatccatcggttcaaggattcgacccatccgcgccagagttctacccactgtgggaattgctcgaaagttttggattgccatgcgtgttccataccggacaaaacggcatgggtgcaggtcttccaggtggtcgaggcattaagctgcgcttctccaacccaatgttgcttgatgatgttgcggcggacttcccgaacctgaccatcatcatggcgcacccttctgttccttggcaggatgaggctaactcgattgccacccacaaggccaatgtgttcattgatctttccggctggtcgccgaagtatttcccagagtctttggtcagacagtccaataacgtgctatccaagaaggtgctgtttggcacggacttcccgctgattaccccagagaaatggcttgcggctttcgcgaatctgccactgaaggatgaggttcgtccgggaatcctcaaagacaatgcggtgaaggtacttggcctagccgctagcactgagcgcggatctcaagcagaaaaggtcgtgcaacatgcgtgatcccattcaaggtgctgttattccttctgatctttttggtttcgcagaagttctcaccgaagccgaacgcgcagttcttctggaaacccgcagggtgcttgaggaagaggtgaagccttatattaatgaggcctgggataaggcagtcttccccgatgagatcgtgcagcccctccaagatctgcaattgcttgatccgcctgcacttcgggaagcaggggagtcggttcgagacattttcactggtttccgcaattttgaactcgcgcgctgtgacatcaatgttggtacctattacaacgcatctgctggtctcttccgaacggcctgcatggttggtggctccccggagcaggcgcagcgattggatgcgcagatcaaatctggtgaggtcaagggcgtttttgcactgacggaacctgatcatggctctgatatcgcaggtggtctggcaaccacggccactaaggacgcagacaccggcgagtggattatcaatggtgaaaaacggtggatcggtggtgcttccactgctgatttgatcgctaccttcgccagggatacagccgataaccaggtgaaatgcttcctcgtggcacctcaggcagagggcgtgtccatggagattattgatcgcaaagcctcactgcgcatcatgcaaaatgcacacattacctataacaatgtccgggtgtctggggatgcgcggctgcacaacatcaattctttcaaggatgtttcggaatgcctgcgccgtatgcgttccgatgtggcgtggatggcggtcggtgcgcaggcaggtgcctatgaagcagccgtgaagtatgtgcgcagcagggaacagtttggccgtccgatcgcggggttccagttgattcaggaaaagctcgcgctcatgctgggcaatctcacggcgtcgctgggcatgatggtcaaactcaccgatcagcagcaggcgggaattttcaaagaggaaaactccgcgctggcgaaaatgtttacctcgctcaaacttcgggagaccgctagttgggcgcgggaaatctgcggaggcaacggcatcattttggacaacgatgttgcccggttccatgccgatgcagaagccgtctattcatatgaaggcacccacgaaatcaatgcactcatcgttggtcgcgccatcacgggcgtcagcgcttttatctaacacacttttaaggagaacatcatgactacttccaccaccccaaacaccatcgtttctttcgaagacgcaccaaccctcaccggccaggacctgggcttttcgcagtggcgcactgtcacccaggagatggtgaacaccttcgcggacgcaactgatgatcagcagtggattcacactgatcctgagcgcgccaaggacggtccttttggtggcgcaattgcccacggtttcctcaccttgtccatgatcattccgttctggggcgagcttctcgatgtcaccggcgtgaccaccaaggtgaactatggcctggataaggtgcgtttcacctctcccgtcaaggtcggttcccgcatccgcatgggcgctgtggtccgtgagatctctgaggtgaagggcaatggcctgcacctggtcgccgatggcactattgagatcgaagggcaggagcgcccggccgtcgtagctaccttcctcacccgcttctacgcttaaaagcttgcttctcgacgcaaaaacccatccggcgcatcccttcaatgttaggggtgcgctgctatttttctccccagttctacgaaatgacttattgtgactaagcttgagcgcatggagcatcctgcttacagccaattgcggccggttaccccgtccgcatctgttgttttgtgccctaatcccggttacagctcgctggaaggcactaattcttgggttatccgggcaccagaagacccccggagcattgtcatcgatccaggtcctgaagatgagggccaccttaacgtcttgcattccaaggctgaggaggtgggtttgattcttctgacccaccgtcactatgatcatgctgacggcgcacagcgtttccgtcagctgaccaatgcacctgtgcgtgcgatggacccttcgtactgtgctggtgcggaggagattcatgatggtgagatcatcacgatcgacggtgtcaccccacagattgaggtggtggccacacctggtcatacccgtgattctgtgtcttatttcatctggagtggagtccctcatgagtccactttggagggcatcgtttctggcgacaccattgcgggtcgtcacaccacgatgatttcagagaccgacggcgatttgggtgagtacctgaattctttggccattttggaggagcgcggcaaggatattccgctgcttccaggacatggtccagatggacaggacgtgtcctccttcgcgcgtaagtacattgagcgtcgtgagctgcgtctgaaccagatccgtgaggtatgggagacccgtggccgtgacgtgtccatgaaggatctcatcgacgccatctacgatgatgttgatccagttctgcgtggtgcagccgagcagtccactcatgtggctattcgttacctgcaggctcaggaagcttccgcctcaaactaaacacttttaactaaacaacaaagaaagcgcctaatcagtatgaaactgatcaggcgctttttagcgctttggtgattatcgagcgcgacgtgccaaatgctcggtgtccacaatgaggacggacttgccctcgaggcgaatccagccacggtgtgcgaacgttgcaagagccttattcacagtttcacgggaagcaccgacgagctgtgcgatttcttcctgagtgaggtcgtggttcacgcgcagcgcgccagcttcttgggtgccgaagcggttagccagctgcagaagggtcttagcaacgcggcctgggacgtcggtgaagatgaggtcagccagggaagcgttggtgcgacgcagacgacgagccagaacgcgcaggagctgctcagcgatagctgggtggtcagctacccagttgcgcagcatgtcagagttcatggttgctgcatgaacttcggtgacacacactgcagaggaggtgcgtgggcctgggtcgaagatggagagctcaccgaacatgtcggaaggacccatgatggtcagcaggttttcgcggccgtccggtgcgtggcgcgcaagcttcactttgccggaggtgatgatgtaaaggcggtcacctggctcgccctcgtcgaagatggttgctccgcgtgggaagcgaacggtctccatatcctggatgaggttattgactgccgttgggtcaacgccttgaaaaattccggcgcgcgacaggatctcctgtacaccttccactgcttttctccttcatctgcacacatcttgtttgagtccggatgagtggcaacacctggggtgttagggtttgagataaaatccggatgacacctaactggaggcatctattaatgtggcaaagaccactctactatgcaattggtcaccatgttagtgcatttggctaaaatgtcacactttagaaaccgtaatttcaatattcacagattgctggcagccaaagtttattttgaataaatctttcaaaataacccttatttaggcagctgatgcttcctgcacgtcaccgtcatttaagttttctgcaccgatagcgtcctttgctaactttacctcagtgttctgcggagcgttggagtgcaggaaagaagactcgattcgctccatcgcaaatgcaaaaagcatcagcaagagcgggatgatcaccacaagcaaacctgtcatgggagtcattctaatgatgaatcaaatccgcgctaacttaagggtatgggttccattactccgcagaagcggcctcgcgtggggtctcacatcgcgaacaagggtcaagagactgatatcgggcgaaaacgccgagctcgacgcatcaatcgcacactcaccgtggcatatccggatgcgcactgcgaattagatttcaccaatccgctagaactcacggtcgccaccattttgtccgcccagtgcacggacgttcgcgtgaaccaggtgacgcccgcgttgttcaagcgctatccgacggccacagattacgccaacgccgatcgcacggaattggaggagttcatccgtccgacaggcttttaccgcaacaaggccacttctttaatcggcctgggtgaggcactaatttcgcttcacgacggccaggtccccggtacccttgagcagctagttgagctgccgggggtcgggcggaaaaccgccaacgtggtgctgggaaatgctttcggtgttccgggaatcacggtggatacacactttggcaggttggtgcgtcgcctgaagctcactgatgaagaagatcccgtcaaggtggaaaaagtgatgaacgaactcatcgaaaagcctgagtggaccatgttttcacataggctgatcttccacggacgtaggatatgtcatagtcgacgcgccgcctgtggagcctgcatgctggcagctgattgcccatcctttggtttggaggggccgtcagatccatttgaggcgcaaaaactcattaaaagtgatgatagggagcacctgctgaaaatggcaggaatgtagaaaacaaatgacaagcagtgcaaagtggtccatcgttggagttgtcgccatcctggctgtgatcgttgcgttaatcccgcagcttgtgggtggagaaagcgcagaggaagcgcagggggagacgtcgacaagcaaaattacgacgcgtcctgactgcgtggcctctggcgcggcgggtgtggatctgccctgcttgggcggcgccaacggcgtcggcaacgagctggccaccgtggtgaatctgtgggcgtggtggtgcgaaccgtgccgcgcggagctgccgatttttgatgaattcgccaccacccaccccgaactcaacgtcattggcgtgcatgcagaccaaaacgcagccaacggcgccgcactccttgaggatctgggcgtgaatcttgcaagctaccaagacgattccaacctgttcgcaggcacccttgggctgccgggcgtcgtgccgatcaccatcgtggtttctccagacggcaatgtagtggacaccttcccgcagcctttcgaaaccatcgatgacctcgaaaccgctgtggcaggggcgctgcagaatgcgtaactaccctgatttaccgcatgatttcccaggtcaaaacacagagctcacccccgcaaaggcacccgtgtggatgcaccgactcttagaccgcatccacaccggccgcatggccaacccgctggacggtgcggaaacgctcggcgacacagactccgaaaagcgcgctgccgtgctcatgctattttctggctcggaaacctcctttgacctgcccaatgacgcctccgtgctgctgacgcaccgcaccccgacgatgcgttcccatgcaggtcagattgcctttcccggtggccgaatcgaccccaccgatactaacgccgtggactgcgccttccgcgaggcctgggaagaaaccgggctggatcgccgcaccgcaaccccattagcccagctcaacgaggtgcacatccgtgccaccggataccccgtctacccaatccttggacactggcacaccccatcacccgtcgccgtggccagcccacacgaaaccgacgaagttttcgacgccccactctacgacctcatcgaccccaaaaaccgcctcatggtcggctggcgcgaatggcacggaccagcgtttcgaatcaacgactacatcatctggggattcaccggcggactactctccgcgatcctcgacaccgccggctgggccaccgaatgggacaccgaccgcatcttcgacctggaaaatacattgtcaacatctcgcaacaatgagcgtatgcgttaggctgacgggctccggtggcctaaaatcgaagcgatctaaaaatttggcagttaatattatcgattttcgaaagcgtagaacaccaaaccattgttgagccccagcctggtcgtcgatgccgtcatcgtcctcgttatggcattcgccctgtggggtggttggcgtcaaggcgccttcacctcgctgctgtccaccgtcggcgtcgtttctggcctggtagttggcgcagcagcagctccatttgtcatgggtctcaccgattccaccgcgcttcgcttcctcctggcgatcggcaccgtggtgctgctggttggtttgggaaatctcatcggcgcccacttgggtgctgcgattagagacaacatcaaattccgaagttccaggaccttagattctgggctcggcgccattttccaagtattggccaccttgatcgtggtgtggctcgtcgcaattcccctggccacaggcctccccggaactgtcgccagcggaattagagactcccgcatcctgggctttgtagacaaatacaccccgcaaggcctagataccctgccctccaaaatcgctgcgatgctcagcgaatccggcctcccaccactgatttcccccttcaccggcggatcctcggtggaagtggacgcccccgaaatcaacgtcaccaacgttgacctagtcgaagcaatgcgcccgtccgtcatccacgtgatgggtgacgcccaagaatgcagccgccgactcatgggttctggctttgtggcatcccccgactacgttgtgaccaacgcccacgttgttgcaggtacctccaccgtcagcctggataccatgatcggaacccgctccgcagaggtagtgttctacgacccgaacctggacatcgcagtcctttacagccctgacctcggcttggatccactgccgtgggcatccactccgctagacactggcgatgaagcaatcgtcatgggattcccacagtccggacctttcaacgcctccccagccagggtccgcgaacgcatcatgatcaccggcagcaacatttacgccaacggccagcacgaacgcgaagcctattcagtccgcggatccatccaatctggaaactccggcggcccaatgaccaacgaaatgggtgaagtggttggtgttgtcttcggcgcagcgatcgacggctccgataccggttacgttctcactgccgaagaggtacaggagcggatcggcgacatcaccgcgctgactcagcctgtcgatacgatgcagtgcgcggtttcttagtcgtcgggagctaggaccagacagggatgcccacgattgcggtttttccgttgcgtgggcagtgtggtttggttttgggggctcggaaccggtcacagatgcccacgattgcggtttttccgttgcgtgggcagtgtggtttggtcttggcagtgaatcgcccaatccgagatagatacgaccaatcctgtgtggcgttttaagggcctggaataggagaggtgtctattggtatgggtcggggaatcccaagcgcttagaggggcatatagggagttttggtttttgagtgactagggggaaatccgtgaggtttgcggtcgaactagatgaaaccagacacacgtgacaaaaattgctaaaacatctaagttttggcacgcctgtttggtttcgagtcgctcaaaccagacacacgtgacaaaacctggcgaaaatcttgattcttgtcacgcctgtctggtccggtcaatgcgccggggtaaaaccagggaaaaaccactaattcacgccaaaatcatgcgaccttctgacgccaaatgagcagcagcgcctcagccacagtgcttaaaacgtggtgcgcgcgaactctgcgatggttgctgcaaattcggaagggttctcgaggtaggggagttcgtagccgccggggatcgcgatggtggtgaatggccctgtcgttcgagtgcgcgcagtattggctagatgttcccagcgtcgagtgttggttctgagcagccacaccggtgcggagactgttttgctggggatcgacccaacgaggtagcggttggtgcggatgatcggggtgatggtgtggtcgatcgatagtgcttttttgcggaggagcactgtctctgtgaatgcgttgctgcgctggtaggacgaggacgtgttgttgacgatctcacgtcgagcttcgctggtgattccgaagtggaagaggttatgcaggaatgagggcaaccgaaaaggagcaagtcggctgaggtcagagacgtgtaggtggggttttcgtcggatggcgcgtcgcatgtcaagggggtggatcgcgccgagggaaattaggccgcggacccgttcggggtacatggaagcgatagcccaggcgatgctggcgccggtgtcggagccgacaagaagtgcgtcatcgtggccgagagctgcgataacgctgctgagttctccggctgcgtggcggaggtcgtagcctgttgggggtttgtcggacatgccgtagccgcgtagatcgatggcggcgacgtggaagccggcatctgcgagtgggccgatgacttcgcggtagtcgtaccaaccgccgaaagccccgtggatcagaagaaccaggggtttggtgggggagcctgcctctgctaaatggaggcgaatgccacgtacggagacgtgatcgtgggtgaacggtccgtctagggcaatgatgccgggggagcgttcaatcgacgcgattgtgctgctcaggcgccgtttggcgcctgtggctttggagcggctgccggggatgaggcgggtgaggggagacgtcgaaaagctaaaaaaggccatcgaagtctccttttttagtggtcgccagtgatggcgccggggctgtggaaggacgcggaggtgtagaggccacgcttgttggccttctccagcttctcggatgcctgacctgggaccaggttcttcagttggttgaccgattggatggtgttcttcggagcgcccatcttcttcaccttgcgccagccgaacagtgcgagagctgcggcgatgaccagcatgaagaggaacacgatgaggaatgctgcccaaggcttaatccactcgctcagcagtgctgcgacgaagaagaaaaagaagaaggagctgtacagtgcgattacgccagcaacgctgaatgcgccgccgccgatggcagctttcttggcttcgcctgcgagttcagtcttcgccagctcaacttctgcgcggaaaaggctggacatttgggaggttgcgttggagatcagcgtgccgatggaggcttcaccgctaacgctggtatccacatcgctgaggggaattgaatccaccttaggtgcaaacgtgctgttaccgtcagtaaaaaggccgtctttgttgctcacgtggaagctcctccagtgtttaaaattagcgttcgttattcccaatcgtgccacgaaatctcatcttgggtgaagtttagcgtgactggacattcgatatacatattaaacgatgcttgtcgacgcccccacccaccatgccactaactgctgtcaggtgaggctcaggccgatccgcgccgtgcgcgtttcatccaccagatactacctgctgtaacagctgcgatgccggcaacaactccggttccgatgccgacgtcgcgggtgctgggcatttggaacagcggttcagggtttttgaagcttaagattttccacccctgttcaagggcgattttcttcagcgcgcggtcggggttgacggcggccgggttgccgacagcttccaacatgggcaggtccgtgaaggaatcggagtaggcgaagcttaaggaaaggtcgtaattgttcgcctcggcgagatccaggatggactgcgctttagcgtcgcctttgcagtaaaacagcacttcaccggtgtacataccgtcgtgggcttcaagcacggtggtgacagttttatgtacacccagttcgcgggcgatgggttccaccagttctttcacagaggcggaaatgatgatgacatcgtggccgagctcctggtggtgctcgatcagttcgcgggcctctgcgtagatggtgggagtgaccaccgaatgcatggtttcctccgcgatcgagcgcacctgttggacttcccagccgcggatcatggcggtgagttggtcgcgggtgttgtccatttgttcactggtgtggccggcgaacatgtacgttgcttgcgcgaggcttaattgcagggcttcgacaggggagatgagcccgctgttcatgaactcacggccgtaggcgtaggtggaactcatggcgatgatggtcttgtccagatcgaaaaaagcagccacctttgtgggggtggtcgcagtggtgccctctactttttgggcgggatctgggtgcttcacaccgcatagtttagcgctttttggcaactttccaagactgagaaagaaactaaagttaccaatgagattgaagtgacgtgctggggttgcgcattgggaatgtagaaggcgtgcgggaagtgtcatttgccacactgttaagtattcgtgttattcgaataaataatcgggtttgatgttgtcttgtggcgtttgatatgccataatttcaggtgcaaggccccgatatacagtgtggcctgccccggcacaatccccccccgttgccgggttactgacggcccgcgcacaccccccccgaggcgcgggccgtcccttattttctaaactagtgcccttagcagattttctgtgcctctgcattcgaaagtgaaaattattcacaggtgagcgtatcgcgggcggttgagaggtgagttatccacaggccgcagagggggtcgttgaaagcacgtaagcctcaggccacagtaggtgccatgaacaccatcacacaccaagcaattctcatcgcagtggaagatccggtcctgcacccagaggccatgcacgtagctgcagccactggtcggccggttattgaaacaacaaatttgatggacatctccaggcattttcaccgcacatcggcagtgctcattgatgcgtcgatggcctctcaattatcacctgggaaacgccgcgacagggtgtttcttctcgattctgatccagggccctctgattggaaaacggcgatgaaaatccacgctgagcaagccatgttgcttcccgctcaggcaggggagttgctcagcgctttaggcagagatgacaaacaactgccggtggcttcgggccatgtcatcggtgttgccggggtggtgggaggaacaggcgcgagcacgtttgctgcggcgctcgcaaagcggcgtgcggagtcagtcaccactgtgcttatcgacgccgacccttcctctggcggcatcgacctgttgctaggaatcgaagatgtgcccggcgcgcggtggcctgatgtggggttgcgtcgcggaactgtccaggctgctgatgtgttgaaagcgctgccgagcactcctgatgaggtcgtggtgttgtctacggcgcggtctaatattctggatccttttgcattatccgagtctgatgtttcggcggcgattgattgtttcttaagcgccgataggtcggtggatgtggtggtggatctgcctcatgcgagagtgcatccagatattgcggagcgcttatcccacctggtgttagtcatccctgcagaggtccgagcggtggctgctgccagggctcggtgtctggaattacaacaattgcatgtatccatcacgtgcgtgttgaggcatcgcgggtggtcaggtttggatgttgcagaagtggaagagattttaggtgcggatattaccgcggaggttggctcgatccagcggctggctaagtccgtggagatgcatgggctgaccggttctttgccgagggttttaagctcagcatgcgacgcggtcctcggggaggtggcggcatgactgacattgatctggtggtggaaaacgtccaaaggattatcgccaccaaagagacaccgccgacctctgcggaaatagcgagcctgattcgggaacaagcaggcgtgatcagtaacgaggacatcgtgatggtgttgcgtcgactgcgcagtgattctgtgggcgtgggaccgttggaatctctgcttgcgcttcctggcgtgacggatgtgttggttaatgcccatgacagcgtgtggattgatcgcggtcagggcgtggagaaagtcgacatggatctgggctcagaggaggcggtgcgtcgccttgccacccggttggcgttgacctgtggcagacgcttagatgatgcgcagcctttcgctgatggccgaatcaccagggacgacggcagcgtgttgcgcattcacgcggtgttggcacccttggcggaatccggcacgtgcatcagtgtgcgagtactgcgtcaagcacggctgagccttgatgatcttatccaaagcggcacggtgcctgaggacatcgcgcctgcgctccggaacatcatcaatcaacggcgctcgttccttgttgtcggtggcaccggcacagggaaaaccacattgctgtccgcgatgctcaccgaagttcccgctgatcaacgaatcatctgcatcgaggacaccgcagagcttcatcccggccatccaagcaccatcaacttggtgtctcgccaagcaaacgtcgagggcgccggcgccgtgagcatggcggatttgttgaaacaatcgctgcgcatgaggcctgaccggattgtcgtcggagagattcgcggtgcggaagtcgtggatcttttggctgcgatgaataccggacacgacggcggtgctggcaccattcacgcgaactccatctctgaagttcccgcgcgcatggaagctcttgcggcgaccggcggattggaccgcatggcattgcattctcaactcgcggccgcagtggacattgtgctggtcatgaaacacaccccttttggccgcaggctagctcaactcggggtgctccgcggaaatcctgtgaccacgcaggtggtgtgggatttggaccacggcatgcacgaagggagcgaagaggcatggtttatgccctaggccttcttagcgtggcggtgttgatctctggttcaaggggccccggcgcgcgtaccaggccaccaacacctgggaatggcgtccatctattcgccctaattgcactattttgcctggccacagtgctatttatcgtcgttgacgcctacacgatgatcgccggcatcatcatcgccacaactctattctggtatctccgccagacacacgccgcagcccaacgcaccaaacaatccctccaattagccagcttcttaagcctctgcgcaggcaatttacgcgccggggtcaccatggtcgacgccatggactacgcgctcgacaacaccacgccggacaaattcttaagccccacgttgcagaccgcagccaggcaggcgcgctcgggcggcagcgggccgcgagtgcttatcgacgcctccctccccgatcttcaacgcctcggccatttgtgggaaacatcagaacgacacggcatcccgctggtcgccctcattgatcaaatgaggtcccggatttcatcgaagcaacgccacggcgaatccacccgagctgcactccaaggaccgcaagcaaccgcagtgatccttaccgtgttgccactagcaggaatgctcatgggcacagccatgggagcaaacccccttgggctactcaccggtggtgggatcggtgggttcctgcttgtcatcggtgtgggcctcgatgctgcagggtttgtgctcacccacaaaattctccagagcgcgagcccctcatgattacagcactagttcttgcagcagtggccatgttcctcggttcacccaaccctggagttcgcggtggattgataagccccaaatccggtaaaagcctgcgtatccgagctggcccaaaaaagctgggcaacgctgacccagtggatgtctctgcagatatcgaactgttttcagcgtgtttggatgcgggtttaaacacacgtgatgcagcgcaggtggtggctcatgttgcagccattacgcaccgcgaactgtggacacatgtggtggcattgctatcgattggagtgagtgcccctcaagcattcgccctgatggcaggagttgatgggctggatgaactagccaatttagccaccgtgtcgcacaggtcgggcagtgcattaagtgatgggtgcaggaacatttccacctcgttgttggcctctgctggtgacaagcgcaccgccgcagcagaacgcgcaggagtgttcatcgccctgccacttgctctgtgtttcctccccgcattcatgattgtcgggcttgcaccagtggtgctcagcttgggtacgcaacttatcaatttctagaaaacacacacaggagaaaaatcatgtccaacaatctcgaactacttcgacttcgcactcgcgccattcttgctcaagacgatggcctcaccaccgttgaatacgccttgggaactttagctgccgcagctttggccgctgttttatacatggtggtcaacagcgacgccgtgtcctcggcgttcgaatcaattatcagcgatgccttgagcgcacgaccgtaaccgatgagaacaaaacagcagcgtgaaccaccggaactgtgcagcgacgatggctctgtcagtatcgaagcagctctcgcattgtcatcgctggtgatcgtgtgcgggttgatcattgcagcaatggccaccttggcggcgtatcttgcagctgttgatgctgccggcgctgctgccagggcgcatgccattggggagagcttcgaaccggcacgaggacacgtcgatatgcatgaagcagggggaatgctcaccgcaacagccactatcccggcaccgattgggcaggtgagcgcgagtgcggtgttcccggtggaaaactagctgtgcaaatgacgaaggctacatgaccatcgccagcgctggtgtcgcctccatcctcattagcctgctggtggtgctggcctggcaggcgggaaacctcgtggccagggaacaagcacaggtagcggccgatgtttcagctgttgccggagcctacgcctttgcccgcggggaactacccgacgctgcctgcgccaccgcgaaacacacagccgaagcaaacaacgcacaactagaaaactgcgcaacagaaggggaggatctcacgctcaccgtcaccgttcgtggacaagaagcccacgcaaaagcaggacctttatgaggttcccaacaaggtcaccatcgcacccagtaacttgatggcacctgccttatccaacggattgtttccattgccgcatttcggggactgcacacagctcgggcacccagattcacagctacagctgcggacgacctcaaatgtggcctcaatccactgggcgaaacgtcgaaaaccagtatccgcaaaaccagctccgccgtccataccgtcatagacaaacacagtggggtagcccgtatccgcatgaagtgccgtggatacgccgccgatatcccaacgatcacacgtcgcaagcagcggcaacataccaatcgccgcatgctccgctgcgtgaagagcaccgggaatatcagcggcgggaatgcccatcgcttccaacgccaacggatcaatcgtgtacgccaccgcacgagtctgaagaatttgaggaggaagatacaacggagtcgcatccaacgtggtgccatcactaaggcgggtgacatagccagtcacacggtcggtgacctgcacctctacgttggcgacccacaaaccaccaccagcatcaaaaacctcgtcctccaacggggcagaggtaatcctgatgtccgtgtcacttctggcataggtggtgtaatcaggcagctcaggcctggccagtgccagattctcctccaaatccaactcatcaatgacaaaggattcaccctggtggagatacaccgcgccgggatgagtctgcgacatcgccttcgcggaatcgatggtgcctaacaaccggccgtcagtgatatcaacaatcatgaactccgaaccagacccaccacgcaaactcacctgctggtgtgccgaatcaggactcagctcatccggatcctctgacatgggcttttccaccgcaaaccagccacgcggacgcttgcgcaacagcccttcaatctcgagcttctccaccaccttttgggcaccaaacgccgcgacctccgcctctgtcagaggcttttccaccgcagcgcaataaacatgaccccgaataacatgcggattcgtcggatcaaacaccgcagcctcaaccggcttctccaacagggctgccggatgatgcaccaaatacgtatccatcggctcatcacgagcaacaagcaccaccaacgaaccctgcccacgccgaccagctcgccccgcctgctgccaaaacgacgccacagttcctggaaaaccagccgtgaccacagcatccagtccaccgacatcaatgcccagttcaagcgcattggtggaagcaacaccgaggagggtgccgtcgtcaagcaatctctccaacctacggcggtcctccgccaagtaccccgcccggtaggacgcgacgcgccgggcgaaatcggggcggcccagcgtgctgagctcttcctgcgcgcgcagggcaacgatttctgcttgtcgacgtgaacggacgaacgtcaacgtgcgtgcaccctcggaaatgagcgtggccataatgtttgctgcttcggtgctggctgcgcgacgcaccggcgcgccgttctcgccctcggcgccttcgatgaaaccgggctcccacagcaaaacggtgcgttcacccgtcggggcgccatcttccgtcactgctttaaccggcgcgcccaacaatctggaagcatgaatttccggatcggagctggtcgcggacgccaaaatgaccgtcgggtgggatccataaaacgcggcgatgcgcagtagacgacgaagcaccatcgacacgttcgcgccaaacacaccacggtaggcatggcattcatcaatcacgatgaacttcaaatggcgcaacaacctggcccagcggggatgattcgccagcatcgacgcatgcaccatatccggattggtgaacacaaaacgactcaaatcgcggatgccggaccgcgcctcggagggggtatcgccatcgtagggcgccggattaatcgggtggaaatccggaatgtcgcgcagcaacgtggacgtggaggttagctgatcagatcccaaagccttggtgggagttagatacaacgcacaggcggtaggatccgtgccgagcgctgacaaaatgggcagctgataacccaaagattttcccgaagatgtaccggtggcaaccaccacatgctggccattccacgccagatgtgcggtctgctcctggtgggaaaagagcttattgataccacgattcaccaacgcatcgcgcaggctagcaggtacccaactcggccaatcgacgtatttagctttcgatgcgggcaacgtcaccatatgagtgagcgtcgattcggagtaacgtttggaaacgattgcggccagctcttcaccaaagctgggcctcatagcttgagtcttttcactctcaaaatcgggggtagtcaagaatttaccccctttcgctgggctgtataaatgggactgacctgccaaaacgtaaaactaatcctaatagactatcgcttgggctttaaacgtgaaagacttgttcccaggtcgcagtttcagtgcgcagtgttcaacgctcgcaaggatagacgtgagcgttcggcattcataccgtcggcgttcgttcaagaaacggccagatgttgctgttcgagctcatgcaagagtggaacatcgaacccggtagtaattccaatcagtaaaggtaagacaaatggcacagggcactgttaagtggttcaacccagagaagggcttcggcttcatcgctccttccgacggatccgctgacgttttcgtccactactccgagatcgagggcaacggcttccgtaccctcgaggagaaccagctcgtcgagttcgaaatcggcgagggcgctaagggccttcaggctcaggctgttcgtgcaatctaattgcatctgagttcgaaaccggtaacttttgtaagttgccggtttttttaatacctaaaacaggtggggctagaagggccgttttattcgtcggcgtgttcttccatgcgtactttgggcaccaagatttcgggaaaatggggcccaaatcggagaaatcttggtgccgaattcacactcgtgctgcgattggcgggaatctgaatttttgccacggtgcaaaaatgaaataaccctcccacatcctcccacgcgggcttgaggtgggaaagtgtgcacaaatatccaactgggatttctaagcctttaaaacggcaactggagtgagctacgggggtagtggattttcgtcctggagtgaattggggttggaatctgcgcggaaatcacccgaatatggctagggtgtgcaggagaccccatttatactgtgtaccgtgttagggaaacgcgtcgtgtaaaactgtcgtgtacaacaacttaagacagcacacgaagtgtatgttcttcccccgcgaagagcaccggattcagtgaaagctactcacttgtggttatgctttccaagagtgaacgtttacatgttcgataattttcgacatagtgggcacagacacgcaataagaacagtggctttctgaagtgttctaaaaggaacatgaagggggtcaaggcagttaacgagagggatgcattcccgtggcagataccgcaggcaccacaggatcgaaaaagaagtacttggtgatcgtcgagtcggcgaccaaggctaaaaagattcagccttaccttggcaacgactacatcgtcgaggcctccgttggtcatattcgtgatctgccacgtggcgctgctgacatccctgcaaagtacaagaaggagccttgggctcgtcttggtgtggacaccgatcgcggtttcgcgccgctttatgtggtgagccccgataaaaagaagaaggtcgctgacctcaaggcgaagctcaagctcgttgatgagttgctgctggcaacagaccccgaccgtgagggcgaggcgattgcgtggcatttgcttgaggtgttgaagccgactgttcctgtgcgtcgcatggtgttcaatgagatcacgaagcctgccattttggctgcggcggaaaacactcgtgagctggatgagaacctggtggatgcgcaggaaactcgtcgtattctggaccgtttgtacggctatgaagtctctcctgtgctgtggaaaaaggtcatgccgaggttgtcggcgggccgtgtgcagtcggtggcaacccgtgtgattgttgagcgggagcgcgagcgcatggcgttcgtgtcggcggattattgggatctgtcggcggagtttaatgcgcgtgaaaacggcaaggcggattcggataacccgtcgtcgtttactgcgcgtttgtccacgattgatggaaaccgtgttgctcaaggccgtgattttaatgatcggggagagctgacctcggaggctgtcgtcgtcgataagcagcgtgctgaggcgttagccgaggctttggaaggccaggaaatggccgtcgttggggtcgaggaaaagccgtacacccgtcgcccttatgcgccgtttatgacctctacgctgcagcaagagtctggccgcaagctgcattacacttctgagcgcacgatgcgtattgcgcagcgcttgtatgaaaacggccatatcacttatatgcgtactgactcgacctcgttgtcggagcagggcatgaaggctgcgcgcgatcaggcgttggagctgtacggtgcggaatatgtttcgccgagcccacgtacctatgaccgcaaggtgaagaactcccaggaggcccacgaggcgattcgcccagctggtgaaacttttgcgaccccgggccagctgcatggccagttggatgcggaagaatttaagctctatgagctgatttggcagcgcactgtggcctcccagatggccgatgccaagggcacgtccatgaaggtcaccatcggtggcaccgcgaagaccggcgagaagactgagttcaacgcgaccggccgcacgctgactttccctggcttcctgcgcgcttacgtggaaaccacccgcaccgccgatggccgcgacgtagctgacaacgccgaaaagcgtctgccactgctgtctgagggcgatctgctcaaggttttgagcatcgaagccgatggtcacagcaccaatccacctgcgcgctacacagaggcgtcgctggtgaagaagatggaagatctgggcatcggccgtccttccacttatgcatcgatcattaagacgattcaggatcgaggctacgtttattcgcgtggcaatgcgctggtgccgtcctgggtcgcgttcgccgtggtcggattgcttgaagccaacttcacctcgctggtggattacgatttcacctcctccatggaagatgagctggacaacatcgccgcaggtcgcgagggccgcacggagtggctcaacggtttctacttcggcgatgccgaagcggatcagtccatggctgaatcagttgcccgccagggcggtttgaaggcgcttgtcgacgcgaacctggagcacatcgacgcgcgttcagtaaactcactcaagcttttcgacgacgccgaaggccgtgccgtgaacgttcgagtcggacgctacggtccgtacatcgagcgcatcgtgggcaccaccgcggaaggcgagccagaatttcagcgcgccaacctacctgaggaaaccacgcctgatgagctgaccctcgaggtcgctgagaagctcttcgctaccccacaaggtggacgtgaactgggcattaacccagcaaacggtcgcatggtggtggctaaggaaggccgctttggtccatacgtgatcgagcaggtcacggactcagagcgcgctggcgccgaagcccaagcagaagaagtcgttgcagcggaacgaaaagctgaagacgaacaacgtgccaccgatggaatgcgacccaagaactgggaaaccaagactgccgcaaaccagaaggaaaagcgcatcaaccagctggttgaggaaaacctcaagccagcgaccgcatccctgttcagcggcatggaacctgcaaccgtgaccctggaagaagccctcaagctgctgtccctgccacgcgaagtaggtgtcgatccttccgacaacgaagtgatcaccgctcaaaacggacgatacggcccttatctgaagaagggtagcgactcccgttccctcaacagcgaagagcagatcttcaccgtcactttggatgaggctcgccgcatctacgccgaaccaaagcgtcgtggacgcgccgctgctcagccaccactgaagcaacttggcgacaatgacgtttccggcaaaccaatgaccgtcaaggacggacgtttcggcccatacgtcaccgacggcaccaccaacgcgtcactgcgcaagggcgatgttccagagtccctgaccgatgcgcgtgccaacgagttactttccgagcgtcgtgccaaggaagcagcagatggcggagctcctgcgaagaagacgtccactaaaaagactgcagccaagaagaccacggctaaaaagacaacagctaagaaaaccgtgaggaaggctccgccgaaaaccaccaaaaacgtggtgaaggccggcgctaagaagaagtcctaaaacatgctgaacgggttcgtgaccaaaacacgccaaggtgcatctgcgctggtgaaagccgtgtcgaaatcagggtccgaacccgagcgggccgccttcgtggcagcggctggtgcacatgtgtgcgccagcctaatgggggtttccaaagtaaagactctgagcaaacccaccctcatgccacttcttgcaggtagggtgctgcgttcttcctgtggttctttagaaaagggtctcgggttagttggccttgccagtggttgggtaggggatctagtgctgatgaagccggattcactgcctaaaggtgcggctggttttgccttcaatcacgccgcgtacatcgcattgttgctgcgcaggggagctaggccaagtgcggtgcgtgcaggaatccgggcagttcctctcctgggtgccgcaggttttgcagctatccgtgaacccaaaatgctccccatcgttcttggatacggaggcctgttagctaccacttccatgctggccgatgactctaaacttcacgattcttccaacctcgcgagctttggaatgggccacggtggcaacttattcttgatctctgatgcggtactttttgcccgtgagctcttccttgaggatggcactgttgctgcacaattcgcagatggagcagtgatgggaacgtatacaattgctcaacttttgctagtagatgggttgttttcggactagctcattggtgttgccaagagaaaaatcccccgtctcacagtgtgaaacgggggatttttgcgtcgaaaagcgtattaggacctatccgccaacgtcggccgaataggccgcgcaatctgcgtcatctggctacgtccgcgcagctccacggacttcatgagcgtccagcgagcctgctccgcctcgttggcctcacgcagcgtggaagcgttggtgacggtgcggcctggggtcgttttcgcgatctccgtcaggcgcgcagcctggttcaccgcgtcgccgatcacagtgtactcaaacctcgcgtgaccgccgatatgaccagcaacgacatggccagcagccacaccaattccggccttgagctggagatctttcagctctgcgcggagctcacgggcagccgcaagcgcatgaccggtggcatcagacaggggcaggggagcgccgaaaatcgccaacgccgcgtcaccctggaacttgttgataacacccttgttgcggtgcacaacctccacgacgtgctcgaagaactcattgagcgcctccacaacctcttcaggagtgtggttgacggcaaaggtagtggagccgatgacatcgacaaacaacacggcaaccttacggtcctcgccacccagagtggggcgttcctccagcgcacgcttggccacttcagcgcccacgtagcgaccgaaaaggtcacggacgcgctgacgttcacgcaggccacgcatcatctcattgaagccagcctgaagcacaccgatctcagagccatcataaatatcaacctgcacatcgttttcaccacgacgaaccctgttgatggcctcctgaagttcccgaatcggatccaccacagaggacaccacaagccggttgcccaggtaacccgtgaccaacgatgcaaacgcgagcgctgcgatggcaggcataattccggaggcatcagagccgaaaatgccctgcgagtagccccaaataagcagcagaattcccatcactggaatgcccaacgtcagcaaccacgtcatacgcaagcgctggctcacaggtggttccagcgtggaatcctcaaatcgacgcgccagggcagacgcagcaaccggacgcaccaaacgctcagcctcaaggtaggtgagcagcacgacgattgcggcagccatcaacgtggaaaacgccacgaccagcgccaaactggtagacacactggccgaaatcaacgttgcaattgcaatgccgattaaccacaccactgcgcacagaattgcctggtagatggggatgcgcataaccaagttgcgcaccatatttcggtcatgatcttcagggcttcgctgccaatcaagcaccgggcggaacatcaaaaatgtcaccagcatgcccgcgacaatggcgaacgccaggtatgcgaaaccaacagctggcagatacgagatctcagcgttgaaatttgaagcatctggctgcggaatgaggaagcgcacaaacagcattactgcgagcgcaccaaacacattcgtgccgagcaccgtcgcagcatacagcggccacgatgtgccccacagccatttcaatgctctaagcaatcgactcatgctcaatactctaacgtgccggtgcgacatcgcgaggatgtagtgaggaagtagtgtagagatcgtgactaattcgagtgtgtttgacagtctcgccggctccaaaacagtgtccaagacgcttttcgacgcggcctccagcgcgcgtgcccttgtccgcgcccgaaccacagaacgtgcccgcgcccgggcagaacaccaaaaccctgcaatgatccacgactccggctttgcccagtcatggctgtttacaggccctcccggatcgggacgttctgtggcagccaaggttttcgccgctacgctcgtatgttcgaatccggatgttgtgggctgtggacaatgcgaggattgccgcgccgccatgggaggcagccaccccgatattgaacacatcgtcccgcagcaattgtctatcggtgttgatgcagctagagaggtcatcaaagccgcagcggtcagtcctgttgcaggaaactggcgagtcgtcatcttcgaaaacgccgaccgactcaccatgcaagccgccaacgccttgctgaaaaccgtggaggaaccaaccgaaagcaccgtgatgattctgtgcgcacccaccacagacccccgcgacattgcgatcaccctccgctcccgctgcaggcacctctacattcccaccccctccatcgcggaagtcgcacgaatcctcgtagctgaaggcaacgtcagccaagcggatgcagaattagcggcggctgcctcaggcgctcacatcggcagggctcgatacttagcgcacaacaacgccgcccaacgcagacgcgccagcatcctcaacctggccgaattaatcttccacggtgatgtcgccttccgctccgtaaacaccttggtcaaaatggtggaaaccgaagccaaagacagcaacaaagaaaaagaagaagccgaactcgaagccgtaagaatctcactcggcatgggggccaaaggcaaaggtgtccacaaagcagtacgtggaggagcgggagatttcaaagcactcgaagaccaacaaaaactccgacgcacccgattcctccgcgacagcctcgacctcgcactcgtcgacctagccggcatctaccgcgatgccatcatcatttcctcccaagcccaagtcggactcacacaccccgatatggaaggcctctcccaagaactcgcaacaaaagtaagccaagaaggactcctggcatgcctcgacgcgatctccaaatgccgcgaatccttcggcttcaatgtacgacccatcgtggccatggacgccctggtaggacgcctgcgcaaagcctacaaagtgtcctaaacaccccaaattattgaagtcaagaacacatcaggtaaagtagccaatcggtaaatagtgaagttaaatttctacagtatttccgtgccgctttagctcagtcggtagagcgtctcactcgtaatgagaaggtcgcgagttcgattctcgcaagcggctccacataaaccccaggtcaaacaaggtttgagctggggttttctgaatgggtgggcggaggccgcgcaattttcgggttttactgcctggattccatttacgatggaacatttttgaagaatacctcgttgaatctagtgcaagttccagcgaaaaccttccaaaactgaccaagtttaagaagattcgctaccctatgaatcagttgtaggagtaagaggggagttagagatgaagatcagaagtgcacgtgaaatcgcggagtggttcgttgcctggggagatgaactcgatgctgaagtctcccctttgaaattgcagaagctcctttattactcccagggtgagcatatagctgcaacagggcgaaaacttttctcggataagattctggcgtggcagcacggacctgtcactccgggcgtttattcagatacaaaatcatacggccgaaacccaattgatcctgatgagtttgtgtcagatgaatttaactgggatgactactcagatgtgtcagatgagcttgtaaccgtatggcgaaaatacggcatctattcggcgtgggcactgagggaaaaaactcacagtgaatcgccgtggctcgatgcctgggcacaagggcaaaatattgaaattacagatgctgcgctgaaagatttcttcttggtgcattagaaatttgaaaaagaaacgaaggtatcgcggccaaccgccaacagataaaccaagcattcctccatcagggccaccacgagatcctggtaatccaaaaattagctttcgtcttatttaacctcgttggggagttgaagaactaaatgcagatcaagctagagcgtttctactgaagtgggaaaaacgttcctcaatgacgtggaatgaaattatgatggcccacaagcatagcctaggttcggaaacgctaccagctaaaagcattattcccgacttgccggaatggatggattctagtgagaagttactagttttaaggcatgaaggtcgcctacctcaagttggtatccgcatcggagatacgtttgaagtcatttggattgagcctgaatttaatgctctttattcgcatgatggcaagaaccggcggtaagagtagagatgatagcaaactgatgttcgccttgcttagaggacttgaaagtttagattcggtgtagctgaacaagcacttatgcacttcctgcagggcaccaggttaaggcagtcagtcattattatcgaaaacccacgactaacaaaaggcctccaccatgaaaactgcttctgatccgattgactggaatccgcagcgcatcgctgtttctggcgtgagtggtgtgggaaaaacgacgttgtgcaagcaaatcgctgcactttcaggattccctcgggtggagttggacagcctttatcatggggaaaattgggtgccgcgtgagactttcgttgcagaggtacaggatttcatcaaaggtccacagtgggtgatggagttgcagtatcggcaggttcgtccactcattgtggagcgggcggatacggtgctgtggttggattattcgacaccgaggcagatgtttcggttgattaagcgaactattccgagaagtttgtttaagacaaagctgtttaatgacaatatcgagccgcctctgtggacgatttttaaggatcctgaccatattgtgcggtggggttggcagactaggaactcgttgaagaaggtcacgccaaccttcgagggacggtttgctccgctgacagtggtgcgcctgagcagcccaaaagagacaaagcgctggttgagggcatatggggaaagcgtgaaactctgatagggtgccatatccatggcagaaagttttatagaggtctcggcggggcatgcggatcggcggatagataagtttttgcgggcacagctaaagggcgtgcccgcgtcgttgattttccgtcaaatgcgtaaaggcgacattcgggtgaatggtcgtaaagtggatccgaattaccggttgcaagaaggcgaccgaattcgaatgtggcagatggatttgctggcagatttgccgccaccggtcgtcgataagcatatttttaaggctgtcgcagacagcgtgctttttgaggacgccgaattactggtgatcaataagccagctggaattcctgtgcacggtggcacggggcacggcggtggcgtgattgaggcgctgcggcagaagtttccgcaggaacgcgacctggaattggtgcatcgtttggatcgggacacctcaggtttgttgctggtttctaaaacgacatctgtgttgcgcgagttgcaggaaattttgcgagaccgcgaagaggagatttttcgggggtatttactcaaggtcgagggggcttggcctggcgatttgcgacaaattgatgtgccgttgaagcggacggagacaactgttgtgccacattcggatggtttgcgggcgcggacgtattttgaggttgtaaagcgtttgccgggtgcgaccttggtgaaggcgcagttggcgaccgggcggaaacatcagattcgggtccatgcgcagtatgcgggtcaccctattgttggcgatccacgatacgggtcgcgtgggggcagagctgcgacgatgcatttgcatgcggcggaattggtggcgcctcgtggggcggggaagcgtcagaaattcactgcaccgttgccgaaggagtggggtatgggacgggtctgagtcgggccttcgtggaatcgcactttttaggccaagaggcgcttttctgagggaggttttggtctcttttgcactttttaacgcgtcgaaaagtgaaatagagaccaaggaccggatttctaaggtcgcgtttggtttaatacggcatctggcctgaaaggacagtgtggaacccaaaaatcatgccctcgcagaatcgtgtttaaagggttaaaacgcctcgacccacactctgacccatccgtgaaactagacctcttaaaacgacttctggttggtgaggtgtgaaaaccgcactgcggggcccaattcacaaaaatccatacgagtgtgcacacccgattttcacatcgcttcgagacctccctttttgacaccttaattgtctaaccccgtataggtgagaaatgttggacaagtgtctgttttttgtgggggaaatctgactacgatggtaagaaataaggaaagagattaccattatgtctcaagagcggcctcaaatcggctcccgcctctctcgtgtcattgaacaagacggcctacaattccgcgatctcgacggcgacggcgtacttgcaccttatgaagattggcgtctaaccccagcagagcgtgccgctgacctggtgaaacgtatgaatgtggaagaaaaagcgggcctgatgatcatcggttcgcactaccccggatactcgcctttggcgccggagagtgaaggcaaagacgcggaaaagtgcgagcctttgctgaaccctgtcgatatgtggcgtgaggataacccgatcacgggtgttcctttcaccgagcctgtgctggcaacttcttccactgaaaatgccattaacctgcgcaatcagcgttacttaattgttcgtgacaacctgccagctcgtgggcttgctacttggaccaatgctgttcaggaagtcgcggagcgatcccgtttgggtattcctgttgcgtttgcgtcgaatcctcgtaaccacgtcgcgctcgttgcgcagttcggtgtgaacgagtccgcgggtgtgttctctgagtggcctggcgagctgggtcttgctgcgcttcgcgatgctgaactgatggagactttcggtaccgaggctgctaaagaatggcgtgccggtggtgtgcacaagctgtacggttacatggctgacctcgcttctgagcctcgttggtcccgcttcaacggtacttttggtgaggatccggagttgatctctgattacatcgctgctgttgtgcgtggtttgcagggccctgagctgtccaagaattccgtgtcgaccaccattaagcacttcccaggtggcggcgtgcgcctcgacggccacgatcctcacttccactggggtcagaccaatgagtacccaaccgaagatgcgctgggcaagtaccatctgcctcctttccaggcagctatcgacgctggctgcgcctcgatcatgccttactacgcacggccaatgaacaactccgccaaccagctcgatcagcagctgtggcaaaacccgaccacgcagttcgaagaggttgcgtttgcctacaaccgcaccttcattcaggatttgcttcgcgacgccatgggccaccgtgggtacgtcaactccgactccggcgtcatcgacgccatgatgtggggcgtggaggaactcagcgagccagaacgcttcgccgcagcagtgcgtgcaggcaccgacattttctccgacatggctaacccacgtcgactgctcgaagcagttgctgagggacaccttgatgagtcagagctgaatcagccagtccagcgactcctggaggaaatcttccagcttggtctgtttgagaacccatatgtctctgaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccctgaaattgcactgtttgaagatgacctcgaaggtgtttccctctctgttgaccctcgtgccaatggtgtcgatgtggaacgcgttcaggctgtggaagctgcagtcccaaccatcttggctgtgaacttcaccaacccttgggtgctgtctgagatcgagcctggtgccgctgccgtggtgggcacttttgagatcaagccagagttccttctcaaggctttgactggtcaagagggaggaccaaagggcaagctgccattgactgttcctgcttccatgcaggcgattgctgattcccctcgcgatatcccaggcaagttcctcgatgagtcttacacctacgtggactccgcagggatggcctacaagtacggtcacggacttaatttctagattgtaggtagtctcgtgggcacaactgaaatcttattgaaaaggagtgtccatgagcactgtagtgcctggaattgtcgcactgtccaagggtgcaccggtagaaaaagtaaacgttgttgtccctgatccaggtgctaacgatgtcatcgtcaagattcaggcctgcggtgtgtgccacaccgacttggcctaccgcgatggcgatatttcagatgagttcccttacctcctcggccacgaggcagcaggcattgttgaggaggtaggcgagtccgtcacccacgttgaggtcggcgatttcgtcatcttgaactggcgtgcagtgtgcggcgagtgccgtgcatgtaagaagggcgagccaaagtactgctttaacacccacaacgcctctaagaagatgaccctggaagacggcaccgagctgtccccagcactgggtattggcgcgttcttggaaaagaccctggtccacgaaggccagtgcaccaaggttaaccctgaggaagatccagcagcagctggccttctgggttgtggcatcatggcaggccttggcgctgcggtgaacaccggtgatattaagcgtggcgagtccgtagcagtcttcggccttggtggcgtgggcatggcagctattgctggcgccaagattgctggcgcttccaagatcattgctgttgatatcgatgagaagaagctggagtgggcgaaggaattcggcgcaacccacaccattaattcctctggtcttggtggcgaaggtgatgcctctgaggtcgtggcaaaggttcgtgagctcaccgatggtttcggcaccgatgtctccatcgatgcggtaggcatcatgccgacctggcagcaggcgttttactcccgtgaccatgcaggccgcatggtgatggtgggcgttccaaacctgacgtctcgcgtagatgttcctgcgattgatttttacggtcgcggtggatccgtgcgccctgcatggtacggcgactgcctgcctgagcgtgatttcccaacttatgtggatctgcacctgcagggtcgtttcccactggataagtttgtttctgagcgtattggtcttgatgatgttgaagaggctttcaacaccatgaaggctggcgacgtgctgcgttctgtggtggagatctaaatggctcacgacggattgcgcgtagaaaacattgtcacctcaggcatctttgcccttgatggtggcgaatgggaagtcgacaacaacatctgggttgtgggaaatgatgatgaggttttcatcatcgatgcggcacacactgcagcacccatcatcgaggctgtcggtggacgtgctgtgaagggcattttgtgcacccacgcacacaatgaccacatcactgtcgcaccagagctatccaaggaatttgatgcaccaatcttcgtgcacccaggtgaccaaatgctgtgggaggaaacccacggaaacctgacccacgaggatttggcagatcagcagaagttccaaatcgctggaactgaactgatcgtgcttaatacccctggacactcacctggatccagctgcttctacctccctgaagcaaacgagctcttctctggagacactttgttccagggtgggccgggagcaactggccgtaagtacagctcctttgacaccatcattgagtccctcaagacctcaattttggatctaccagcggaaaccaccgtgcgcactggccatggtgatcacaccagtgtgggggctgaggctccacacttggaggaatggattaaacgcgggcactaagccccgaacgattagtaggcttgggcaccatggatcttaaacttggtggccaagtcatacttgttgttggcggtgcaggaactattggttctgaagttgtaaaactcttaactgaagaaggcgcaaccgcggtagcggcgtcgagaagcacgcccttatctattgacgcttcggatgaagcgtccgtccgtgcgggcattgatcaggtgatcgcagaacatggtcgcctggatgggctggttgtttcttctgcacccgctgcgcaaacgctcagcgcggagacagcagatgatccggacactgtgttggctgctattgaaggcaaagccatcacgtttatgaaggctgcaaccgtggcgctcgagaagatgcgtgaggctggacatgggcgcatcgttgcactttccggcatgaactcatacaaaacattgagtactactgcgtcggcgcgaaatgctgcgctgaatgtcgtggtgaaaaatttggcggatcgtcacgcgggcaccggaattacagtaaatgcgattagcccgggattcgtggtagctgagccagacgctgaggtaaaccgcgcaaatggtgacaccacggtggaggaggtcgcggaggcgatcgcgtttttgttgtcgccgcgcaccgcatcaatttctggagagattatttcggtgggacataaggcgaagggcatcatccttccttagctcgcgtgagcttcccaagcgtaagcacccccgtgtgagggcataacggccgttctgttaaagattggtctggccatttcctccatatgggggtgtccgcgcttaacatgtctgacatggtggcgaacaaacgggcacagcgtaaagtctggctagcggtagctttatcggtctttacggtcgcgtggggtggcaatgaattcactcccttgctggtgttttaccgaggtgaagggttctttagcaacctgttcatcgaccttttgctggtgttttatgccatcggagtagcggtaggtttgctggcagctggtcctttatctgaccgctatggccgacgtgccgtcatgttgcctgcgccattgatcgcgatcttgggttccgcgttgattgcctcgggtgaagaaaccgccatcctgattgccattggtcgagtgctgtcgggaatttcggtgggcatggtgatgacagcgggaggttcctggattaaggagctttcatcgtcgcggtttgagccaggggtgaaaaccagtgctggtgcaaaacgcgcatcgatgtctttgaccggtggttttgcgctcggcccagcgcttgctggtgtgatggcacagtggctgccactacctggacagttggcatatgttttgcacattattctcactctgattttgttcccgttgcttattacagcgccggaaactcgtcaatcagcgcacctgaaaactaagggatcattctggtcagatgtgcttgtgccatctgcactagacaagcgattcttgtttgtggttgctccaattggaccgtgggttttcggtgcggccttcactgcctacgcagttttgccgtcgcagctgcgtgacatggtttctgcacccgttgcgtattctgcgctgatcgctttggttaccttaggttctggatttggtatccaacaattcggtcctcaaatcatgggcacctctaaaactcgcgggccgattttggccatgttcgtcacagtcatcggcatgatcggcgcggtgatcgtggtgatgaaccctcatccatggtgggcgctagttgtctgcatggccctcggtctgtcttatggcctgtgtatgttcatggggttggcggaaactcaaaacattgctccacctattgatatggcaggcctgacgggtattttctactgcctgacgtacgtaggtatggtctttccagccttgatgacctggttgaatcaatggctcagttacccgttcatgctgggctttggtgcggtgatggcaactatttgtctgatcattgtgagttttagtgcacgccgattctgagaaacaactaaagtgagccacatgcgcacagtagttaccggcggtgccggcttcatcggatcccatctcgttgaccttttgatcaaggaaggccacgaggtcgttgtgatcgataacctctcccgcggacgcctggagaatctctccgatgcggaagccaccggaaaactcacctttgtggaagccgatcttctcgacgttgatttcaacgagtttctaggaacccacaagcctgaggttattttccacctggcagcgcaaatcgatgtgcgccactctgttgtagatcctcttcacgacgccgaaaccaacattttgtccaccatccgcatcgctgacgctgcccgccagcacggtgttcgcaaggttgtctttacctcctcaggcggttccatttacggtgagccttcggaattcccagttgatgaaaccgtgccagtggatccacattccccttatgcggcatccaaggtgtccggtgaaatttacctgaacaccttccgccacctgtacggcttagactgttctcacatcgcaccggcaaatgtttacggcccacgccaagatccacacggtgaagcaggagttgtggccattttcgcgctgcgacttctgggaggcctggacaccaaggtattcggcgacggcggaaacacccgcgactacgtctacgtcggtgacgtagttcgtgctttctacctggcttctggggaaatcggtgggggagagcgcttcaacattggcacctctgtggaaacctctgaccgccagctgcacaccctcgtggccactgcggcaggttccaaagatgatcctgaatatgcacctgcacgtctcggcgatgtgccacgcagtgcactcagcttcggcaaggccaaagaggtgcttggttgggagcctgaggtgaacatcgaacaaggtgtggccaagactgtggagtacttccgcactcactaggggaaaatccaccacaaatcgctctgatcagtggaaacgtggtgggtttttgcattttccgcactcaaaaacgcaaggatccaccacagatctcaagatacttcagggatgtggtggatccttgccctggaagctcacagctaccccgaagggattgatggggcgcgctgacggggaaaattcgtccccgtcacgcgataaaaggccgattttggtcgaaaatttgcgctaattccgggctattatgcaaaaacccgttcgatttagggactcctgggcgatttggggcgaaaagttgatcagcaaacctgctgcaaatctgcaggaatcacacctgcaacaccagccccaaaatggaccccctctaaaaccgtctctaagcgctcaaacggtcccgacctatacaaacactcattcgatacaattcaagcccttaaattgcctccagaggccaagcgctttcctaagcggggtcagaaccctgggaatcctccggcagcaccacattttgcaaagcgacagcgcgggccagcttggaataacgcagctcttgttcacggaaacgcacataactggacagcgtggtgaacataaatgccacaaccagggcgtaaagcattaggtcggtgccgcggtccacgcccacaaagttggctagttgggtgaggtcatcggggcggagcactgcccatactgcggcgaaaatgaatactacgaagccgattttcacccatgctttggcgcgggctttgcggcggtttcggaggaaatatagtgccagtgctgcggttgccaggagaagcagtatctggatgatgatttgggtggtggtctgcgtcatgggagtctcctcgctaggaagccgtcggccaggatgtttacgccgttgagcagggattgccccttgctcatggagtattcggtgtagaggatgtctacgggttcttctgaaatgcgccagccgcgttcatcgatttggtcgacgatttcggatgcatgcgacatgccgttcatgcggatgttcatttcctgcgccactttttggttgaatacgcgcaggccgttgtgggcgtcggtgagcccaagtcggcgggttttcggtgacagcaggaccacggtgcgcagcacaaggcgcttgattagtggcacctggtcatcggcttggcgtgggcgtccaaaacgcgtgccgacgataatgtccacgtcctcggcacgcagtcgctccaccatgcggataacgtctttcacttggtgttggccgtcggcgtcgaaagttacaaagtattttgcaccgggttgcttgcgggcgtattcgatgccggtttggatcgcggcaccttgtccgaggttcacggggtggttgaccaggtgtgcgccggccgcatggatttcttccgcggagttgtccggggagccatcgttgaccgcaacaatattagggaatgttttgagtgcgttctctaaaacttcccggataactgttgcctcgttataacaaggtacgactagccaggtgtctttaaagtcgctgttttttgatgcatccatgataggaatagagcctagtgcatgatggctgattttcctgttaggtgccaccgaccccagtgatgataacttgattgtcatgaaatccattgatcttgagcagctggcgggcacgcaatcgcgcacgtatcaatcgcgaaagatcaccgatgagatggtcgcccggccggtgcatgtggcgatcgcgttgtgggaagtgccgtgggagtcggcaaaatccggcaagattgagggttgggtcattgccgtggattcgccgcgtgggcggtttgtgcgcagcgggcagaccaaaaatggcgacgccgtcaaccggactgtgtcgatgctgaaatcagcgttgaaaggggtccgcgggaaggcgtggattgtaactgggcgtcgacaagcagctttacgcgcagccctggtgcgcgaaaactacctggtcaccggaagcttcgccgagcaaaatagggccggcgtgaaggcgtcggcgatctcgcgccgcgccgaacaatccgcgctctacaaggcgaaaaaaatcggcgaattcgccgagcgcgccccacgcgtcaaagagcggcaagaggcacattggtggccacggttgtcacgcacgcaaggcaccgcaggcgttttacgcttagcgacggacgcctctaccgatggggtcttccgcggcgccatgtgcttcgtagcctcaaacggcgactacctcctggagacccaagacaccaccgcaagctccgacgaattagaactcgaaagcatcacccacgccctgatctacctcaaaaccatcggcgcgacccaagccatcatcgaatccgacagcaaagccgcacttgaagccatcgacttcatcctcaacaaccgaccgcgccggggcaggtggcgcggcatcaccgcatgcgcccgcaaccggttccgggatgcctgggaagcgcttatcgacgactgcgttgtggaattatcccgcgtactagggcacgccggggatccactgaaccaagcagccgaccaaatcgcatacatgggcatgcgcgccgtaatttttgaacaaaaatccgcacaccccacattgctcaaaggaattgacaaggcgcttcgcaaggccgagtaaggtgggcaacgagtcggtgagagtatgaggaatatttgatgagcaacaaacgcatcggtgtagtgatcgtttcctacggacacgaacaagatgttgccaacctggtagacacatttgcagatcagctgaaaactggtgaccgcgtagttgtcgtggacaaccgcaaaccttgggtgttaaaagacgccgtgggggagcgcctggaaaaacacggcgcagagatcatcaaccacgacaacggtggtttcgccgctggctgcaacgtgggcgcagcgcacatcgtggatgacgttgacctgctgttcttcctcaaccccgacacagtgatcgacgatcccaccctgttcaattcgctgagacgcgtcgatgaacagtgggcagcattcatgccgtacctgctgcttcctgacagcaccattaactccgcaggcaacgccctgcatatttccggactgtcgtgggtgactggtctggatgaaaaaccagttgaaggctcatctgaagttaccgatatttccattgcctctggcgcctgccttgccgtgcgcgtggactggtggaaacgcctcggtggcatggaagaactgtatttcatgtaccacgaagacactgacttctccgcccgcttgctgctggccggcggtcgaattggtctcctgcattccgcgtatgtcacccaccattacgactacgccaagggtgactacaagtggatttacatcgaacgaaaccgacacgttttgctgctcagcgtgctgccgcttccattgctgttcgtgctgatcccgcagatcctcggtgtgaacctgggactgtgggcgattgccgcaaaggaaaagagggtcggactcaaggtgaagtcccttcgcctcctgatccgcgatctaccagcgattttcaaactgcgtaggagcacgcaggagcttgccgaactcacaccatcgcaatatctggcaaaaatggaatggcgcctagacaatcccaacctaggcaacattggatccaacaagattgttgcgactggatataagacctattacaagttgtgtatgagtatcctgaaattgctcgcttaacaccccataaagagggtgaagatttaagttcaggtgcgatctgggtgaacagtacataaatatcatctttcgctaatggaaagccccagctcaccgaattctccattcgttttaattgcttcgttaattaaaacgccatataaaaaccggcgcattgccggtatttttccaggagaatttaatgaagaggctttcccgtgcagccctcgcagtggtcgccaccaccgcagttagcttcagcgcactcgcagttccagctttcgcagacgaagcaagcaatgttgagctcaacatcctcggtgtcaccgacttccacggacacatcgagcagaaggctgttaaagatgataagggagtaatcaccggttactcagaaatgggtgccagtggcgttgcctgctacgtcgacgctgaacgcgcggacaacccaaacacccgcttcatcaccgttggtgacaacattggtggatccccattcgtgtcctccatcctgaaggatgagccaaccttgcaagccctcagcgccatcggtgttgacgcatccgcactgggcaatcacgaattcgaccagggctactcagacctggtgaaccgcgtttccctcgacggctccggcagcgcaaagttcccatacctcggcgcaaacgttgaaggtggcaccccagcacctgcaaagtctgaaatcatcgagatggacggcgtcaagatcgcttacgtcggcgcagtaaccgaggagaccgcaaccttggtctccccagcaggcatcgaaggcatcaccttcaccggcgacatcgacgctatcaacgcagaagcagatcgcgtcattgaggcaggcgaagcagacgtagtcatcgcattgatccacgctgaagccgctccaaccgatctattctccaacaacgttgacgttgtattctccggacacacccacttcgactacgttgctgaaggcgaagcacgtggcgacaagcagccactcgttgtcatccagggccacgaatacggcaaggtcatctccgacgtggagatctcctacgaccgcgaagcaggcaagatcaccaacattgaggcgaagaatgtctctgctactgacgttgtggaaaactgtgagactccaaacacagcagtcgacgcaatcgttgcagctgctgttgaggccgctgaagaagcaggtaatgaagttgttgcaaccattgacaacggcttctaccgtggggcggatgaagagggtacgaccggctccaaccgtggtgttgagtcttccctgagcaacctcatcgcagaagctggactgtgggcagtcaacgacgcgaccatcctgaacgctgacatcggcatcatgaacgcaggcggcgtgcgtgcggacctcgaagcaggcgaagttaccttcgcagatgcatacgcaacccagaacttctccaacacctacggcgtacgtgaagtgtctggtgcgcagttcaaagaagcactggaacagcagtggaaggaaaccggcgaccgcccacgtctggcattgggactgtccagcaacgtccagtactcctacgacgagacccgcgaatacggcgaccgcatcacccacatcaccttcaacggtgagccaatggatatgaaggagacctaccgcgtcacaggatcatccttcctgctcgcaggtggcgactccttcactgcattcgctgaaggcggcccaatcgctgaaaccggcatggttgacattgacctgttcaacaactacatcgcagctcacccagatgcaccaattcgtgcaaatcagagctcagtaggcatcgccctttccggcccggcagttgcagaagacggaactttggtccctggtgaagagctgaccgtcgatctttcttccctctcctacaccggacctgaagctaagccaaccaccgttgaggtgaccgttggtactgagaagaagactgcggacgtcgataacaccatcgttcctcagtttgacagcaccggcaaggcaactgtcaccctgactgttcctgagggagctacctctgtcaagatcgcaactgacaatggcactacctttgaactgccagtaaccgtaaacggtgaaggcaacaatgatgacgatgatgataaggagcagcagtcctccggatcctccgacgccggttcccttgtagcagttctcggtgttcttggagcactcggtggcctggtggcgttcttcctgaactctgcgcagggcgcaccattcttggctcagcttcaggctatgtttgcgcagttcatgtaataacttgtagtaaataaatcgggccttcccaaaagattctttcttgggaaaggcccgattttggtatttgaggtcttttagtggagtgtcttagacatttgtcgcaacactgactaactggcggtcgtatttgtcagttgtcgcactttcaagcatgacccacgcagcatcttcatatgaggtgtacattccggtttctcgatttactcgaacaacacgattctcaagcttactgcgtgccccttgagcatccataagggaagtgacgggaaactgtctttaagccctgaacgtaagagatcaacgatgctagtggacagtctttagatgcctttcatcgcatagattattaaaatgcaattaccagccagatttggttgatgaagtcactgttgttcggggaatatttcagcgataagtctctgttgttcttcttgttgtttttgtaaggctttccaagcggtactattttgggctgttttaatgtccgcagtgagacggttggatttgtctactattttcatgaattctttaaattttatacctcctgcaatgaaagctgcgactacaagtatgagtccaagcacagctcgtgtgccgtcgtcaaagataaagctgattgcgtaggctagtagggcgactgcgatgatgtaaattcccagtatgagagctattttcttgcgcactacttttcggtcttgcatcaagctgtaaatgtggggatcgatgggggtttccatgatggctccttggaggattggtttccttgtttattgctttatgtatttgctgccgtctcgtgggttgtgaaagttcaaatatcgattgagcacgcggtcccatgtgacaattttctgtttctggattggtatatgcaatcgggggtcatccccacttgcgcggggaggatccttggctgaaagctggccgacccattcaaaagggaccatccccacctgggtggggagaacgcgtccccgacgtttttaacaagcttgttgacgggatcatccccacctgggtggggagaatgctaattaaccagcagaaatgttgaatccaaaggctattttacatcacttagattttgaatcagagtggtactaatttctgagaaatataaatggttccaaattcttgtattgaataattgaaacccaaaagcggtgccggaggaaccgacaccgcttaaaagtaactctccaaagccagggataaagtctgaacttcagtaaacctaaaccgcctcaacctcagcaaacgaagcagtatcaatgacaacgcggaactgaacgtcgccggcaacaacacggtcgtaggctgcatcaacatcgttgacgccgacagtttcgatcatcgcaccgaggccgtgttttgcacagaagtcgagcatttcctgggtttcagggatgccgccaatgttggatccggtgaggacttttccgccgccgatgagcgcaccgaagctcagtggctgcttctctggtggcagaccgacaacagccatgacaccgtgtggcttgagaaggctcaggtacttgtcgactgggatggatgcgctaatggtgttgaggatgaagtcgaattcaccggcgtgttcggtgaagaaatcctcatcagaagtcgcaagcgtgcgagctgcgccgagttccttggcaagttctgccttgcgcagggaacgggacagaacggtaacctcagcacccttggctgcagcgatctggacacccatgtgtccgagtccgccgaggcccatgactgctactttgtcgccttctttaacgttccagcgagcgattggggagtaggtggtgatgcctgcgcacagcagtggtgctgcgacatcgaagttaagttcctctgggatgctgcacaggaaacgttcgttgaccactaccttttcagcgtagccgccttgggtgatggtgccgtcgacgtcgttagagttgtaggttccgacgtttccgcgaaggcagttgttttcaaatcctgcgacgcactgttcgcattcgccgcaggagttaacgaggcagccgacgcccacgcggtcgccgactttccatttggttacatcggatccaaccgcagagacaacgcctgcgatttcgtggccgacggtgagcgggaagtgcgcctcgccccattcgttgcggatggtgtggatatcgctgtggcagatgcccgcagctttgatatcaataaccacatcatctgcgcgtgggtcacggcgttcaatgatcttgacctcgaaaggtgcttctgggccggacttttgtagtgcttttactgagatactcaccccagttagcctaccgaaaaatcaaaagcgcctacgagcgcttctcgacgcacccctccacaaccacaccgtaaattacaaagctctcagcaggtagtttccgtagcctgatttcttcagttcctcaccaagcactgtgagttcttcagctgtgatgaaaccttcgcggtacgcagcgacttcgggggatccgatgatgttgccggtacgtttttgcaggacctcaacataggaagacgcctcggacatggaatcgattgtgccggtatctaaccagacatcgccacggtccaggcgctgcacagttaaagcaccttgctggaggtaggcatcgttaacggaggtgatttccagttcgccacgcgaggaaggcttgattgacttggcgatgtccaccacgcgattgtcgtagaaatatagtcctaccacggcaaagttggattttggcgcggtgggcttttcttcaatagacaccgccttattagcagcatcaaattccaccacgccataacgctcaggatcggagacctcataagcaaagacaatgccaccgtcggggttggagcactgctttagtgcgtggccaagttgtgcgccgtcgaagatgttatcgccaagcaccaacgcgacgtcgtcgtcaccgatgaattcctcgccgatgatgaatgcttgggctagtccgtcgggggagggttggacggcgtaggtgaggttgatgccccaggaggagccgtcgccaagcaagcgttcaaaggaggcgctgtcttcaggggtggtgataatcaggatgtctttgatgccggcctgaatgagcgtggtcagtgggtagtagaccatgggtttgtcgtaaatcggcatcagttgcttggagatgcccttggtgatggggtagagccgggtgccggagccacctgcgaggatgatgcctttcactttgagagttccttgaggtagtcgttgaggcgggtctgccaggtcggtgcgctaaatccggtggcttcgattttgccgagatccaaaacggagttcagtgggcggggcgctgcgtctttgttggcgaagtactcggcggtgctcacgccggtaactttggtggggtcggaaaatactgcgcgggcaacatcggcccagcttgcgggttcgccggtgttggtgaggttgtaggtgccatatgctgcacccacttccaaaaggtgcgcgatgccggctgcgatgtcttcggtgaaggataggcggccgatttgatcatcaactactgatggtgcgatgccgcgttcgtcgagggatttcatggtgcggacaaaattattgccatcgccaatcacccagctggtgcgcacaatgtagtggcgcggtgcggtggtggctgcgatgtcgccggctgctttggattggccgtacacgccgagtggggaaaacggtgcgttttcatcgtaggattcggccgcaccgtcgaagacataatctgaggacacgtgcacgagggtgaggttgttgtcgcgcgcgatggtcgcgaggttagccactgccgctgcgttgatgtcccacgctgctgcgcggtcgtgttctgcctggtcaacggcagtgtaggcggcggcgtttatgatggtggagtattgtttccacgcgcgagcctcggtgagatctgaggtgatatcgagttcttggcgcgtgacaaattccgcgtctgggaactgcgcgcgtagcgcggttcccagttgtccgccggcgccgaccacgagaaccttgcgggcgggcaggggggtggcgtcgataagcgctggatgttttttatctttttcggagatctcggtgatgggcagcggccagtcgatcatgttgaggttgacgttggcgtaatgcgcgtcgggggaccaatgatcgttgacgaggtaggtgtacagcgtgccgtcctcgagcgcctggaagccgtttgccacaccacgcgggacgtaaactcccacgtcaggggtaattttttgcgttacgacgttaccgtacgtgctcgagcccgcgcgcagatccacccaagctccgaaaacggaacccaccgcgacggacacaaatttatcccacggctcagcgtgcatgccgcgagtcgtgccggcggtggcgttgaaactcatgttgttttggacggggccaaaatcgggcagccccaggttggtcatcttggtgcgctgccaattttccttgaaccagccgcggttgtcgccgtggacggggaaatcgaaaaccagtaggccttcgatgtcggtggtgtgggaggtgagttgtttaccgtattccattattgtccctgcttagcgtaggtagcttcgacgttgttcttggcagggcgccaccaggcctcgttttcgcggtaccaatcgatggtctgctctaggcctttgcgcatgccggaatcaacgtcggtgtatttaggtgcccagccgagctcggtgcgcagcttggtggaatccatggcgtaacgcatatcgtggccggggcggtctgcgacgtgctcgtatgcgtttttgtcgaggcccatgagttcacaaataagctcgatgacctgcttgttattcacatgatcgttgtcggcgccgatgatgtaggtttcgccgatcttgcccttactcaggatcaggtggacggcgtcattgtgatcatcgacgtggatccagtcgcggacctgctcgccggttccataaagttttggtgtcaggccggccagaatattggtgatctggcgggggatgaacttttcaatgtgctggtagggaccgtaattgttggagcagttagacatggttgcctggattccgaaggagcggatccatgcgtgtaccaagtgatcagaccctgccttggttgcagaatatggagacgatggcttgtaggcggtggtttcagtgaagcggtttggatcatccagctctagatcgccgaagacttcatcggtggagatgtggtggaagcgtttgttgtgcttgcggactgcttctagcaggacaaaggtgccgatgaggttagtgtgaacaaacggggaggggtcgttgagggagttgtcgttgtgggattctgctgcgaagtggactgtgatgtcgtggtctttgaccagggagtcgactaattcagcatcgcagatatcgccttcgatgagggttactttgctgtcggggaggcctttgagattgtcggcgtttcctgcgtaggtgagtttatccagcaccgtgatgtgggtgtattcagggtgctgctctacggtttggcggacgaagttggcgccgataaatccggcacctccggtcacaagcaaagaagtcatgccgtctaccttagttcgtccgggcgagctggcagagttagtagctgttgtcgatgcgcctattctgcaaacgaccagggtgctccggctgttcattagggaatccggtagcaataacaagggcgattgcacgatcctcacgcccgccgagaccgattgcttccttcactttttcctcatcccaaccagtagtcgggctggtactcaaaccctccgcctgggcagccagaattagaaaagccgccgcgaggctggcatccctcaacgttgcttcgcgtgcctgctgaatgctgcgaccgttgatgaatcccgcgacacgttcagccctttccgtaccaagaatctcttccaaatcctcaggctcgttttccacgcgggcaaccgcaatgaaagttacaggtgcggtgaggaattgtttctgatgggaggcctcgtaaagcttctgcttctgtgcgggatcagtaatcacaacaatttcacgttgctgcgcattgaacgcactgggtgcctccagggcaaggtcaacgattttgtcgatcagctcaggggtaggagcttcatcggtgtatttgcgggtggcgcggcggttggtaatcgcctcgacgactgaaagtgacattttttatcctttttatgtgttggaaacagagtcatggtaggtcgccttatttgtcagtgcaagggttttattagcttttggagatagtttctggctggttgaaatagttgacatctgtgcaggttgggggcttttgtttccgacttggggttatgtgaagtggggtgctgtgtggcgttttaagcggtcgactgtctgcggcgacctgttgtcctagttttggcgagttgggtgcttagaagcggttttagcgggggtcgaatttgtgacgattggggctattttgatttctgctgggttgctgtgggcttgctgatcaacttctcattccaacggggcctcacgccctcaaacggggacgagttttcgcattataccccgtgattagcgcaaattttcgattaaaaatggccttttccctctggctggggacggattttcgcaacttcagacagtcacgtgtcgggtggggtgtgggaggacccatgtaggcggcgcctactgggtgatgatggttaggattctccatttttaggatgccacctcgaaaaaatggtgaatcggcacgcttttaacctctcgaaagtgtgccaattcaacatactctgcgcccacctttcggaaaatggtgaatcctaacggctttaggggcctgtaaggcgaaacttattgcgggggtacgtcttggggaaagagttaaggataaccttgccttaattatttgagttacagtaatttaagtgaatgcatttttgtctcctgcctctggccaaacctgccaaagttgtggccccgctcctcggcgtcgcactccttctaagctcctgttcttcaacatcttccgatgaatcaatccaacctgaagttgccagcactggatattcagtggagcacgcaatgggcaccaccgaaatccctgaaaccccaacgcgtgtggtcgtcattgattccccacacctcgacgcacttttggctttgggaattactccagtcggagctacggaatctggatccgaaaatggtttccccgcctacttggctgacgagctaaaagacaccgaatctgttgggctgacatctgagccaaatttggaaaagatcgccgcactggatccggatttgatcattggcgcaaaggtccgccacgaggctatttatgatcagctttcagacatcgcaccaaccgtgatgtccgaaggttccggcacaaactggaatgaacaggcagaaatcactgcggcagcagtaaacaagtctgatgagatggacaaactgatctcagacttggacacccgtgccacagagcttggtgaagagatcggtgctgacggacaaaccgcttcaatggttcgattccgcacggacaacttcaggctctatggtcccgagaccttctctggttcagttctggaacaagttggatttgacctgggggaacgtgattggaatgagtactccatgatggagctatcctcagaaaactttgggcagatcgatggagaccttattttctacaccatcccaggatcccctgaagcaaccacttatccaaagatttccgaactgtgggttgattcaccagcagttcggcaaggtagaacttacgagtttgaagacgaaacctggatggtcggcatcggtgtattaggtgccaatgaaatcttggatgacctggaagaaactctgagctagtttcctttaggccaagcaacccctcgccgttgtccctccgcatattaggagagtctcgatgacgaggggttcttcttattcgaagaactgtcttcgaagcactatctactcaaactcgaattcgagctcaatcttggtgtcttcgtatcgatctgtatcgagtttctcggtgaattcgtggagcaggtcgttgtagaaatcaaccgcttgatcttccaacatttcccggttagtggttacttgctcgacgaagttctcttggctcatgatctcagaaactacttctgcagtatcgatatcgtcagtgctgaaactgatccaaccgtcatcttcggctatggtcttaaactttagatcgtcgtatccgatgaagatgaactcagggatagtgatggaaagcttattgtcacctgcggatttgatttcaacatctgaggcatcgattccgagttttccggtgtagctgtattggacgtgcacggtcttttgcgtgccaggaatacgttttccacgaattgtacgttcaacggttttctcatggattccaagtgctccggcgctgagaaggacgatttcttcttcgcgctggagagctctgatgaccatggagtcattgactgttgtgcgagttgaagatgatgtctgctcaccgttttgcgagttaattagcagcaaaataccgccagttactacaccgatcagtgcgattagcgcgaagagcctaaggaatagcctgtttggaagcacgtgttttgctttctatgaatgtggtgggcattcagtcttccgcggtcttcttgctatggaattgcaggtggtgtgtggaaacttaatgcgatattgagaggatgtgtggaatagtagcaacttgtttaacaaagtaaaactgaactaccacgtttttcacagggacttttgctcttctaagcaatcgaaatcccccaatcaaaccaaactatcccgcagtcaaaacccgattccgatccccaccaacaaacgctcccatgtgtaccagcaaaccgcagagtgggccaacaatgagcgcaaggccagcagcgacgcccaaatcaaaaggtcccagcaagaatccgacggcaacaacagtggcaacaacccatccggtgagatagatcccgtgacgttcaaaggcgatcgccgcgcagccggacaccatcaatgaagcggtggtggtggcgcctaaggtgagcatcgcgagtagccagccagggaccgcgaagagttccttttggagtacaacgtccaggatccatgggccaactaaccatgcaagaccagctccaacaagtccgactgcccacacaattgccaacggacccgccaaagttttcaatggaccggacgtacctttgacaaaacgaacgatgatcgccgattggaattgctgcagcggaaccagcaggggagcgcgggtcaggatgacggcgtaggaaacagcggccatcgaaacccctcctgcaaccgctgaagggttcgtgaatttcagcagggtcgggaaaccagtaatcagcactgccgtggcgccggatgctgccatcgcaagcagagcctgtcggatgaaaacgccccgtgaaacatcagcaaccgatcccaaaacggaacgcaccgaaccgaagcacagcacgatgaccagccaggatattgatcccacaacggtgatgatcaagaacgccagcaattgataacccagcaaccaggcggcaacagctaaaaccatgcgcacgccggtgtccaaagaaatcagcgaggcatactctttccacaattggcagccggacaaaatgccggagattgtcgcttggatcgcgtagctagcaagacctacagcaagtagcccaacaccaacaccttgcaaattacttaaaagctggccgatccacagcggcgccgaagcgccaagcaccacgagcactatcgccgcaaccacgaagctaaacaaaaacggcctaaatccaacaacagaaccagcacgcccaccacgagaaccaccacgagaaccggccgtcaccgcgcgggtcgtctcctgcgtcaacccagtcagcactccggttcctgcaaagaacagaccccagtaggcggtgaattcttcggaaagttggctggaatcaccaagggcccaggcagcgatgatgatgacgacgaacccggagagacctgcgatgattgtggccagcgtcagatagcgcactagtccaaaccaccagaaggaaactccggcaactccagatcgcgaagccaggactgccacactgcatctaaagctgcgtggtctgtggagactgcgtagaggtgtcgtttcaggtcgcggggttcaacgagtccgtgtcggccttcggcaacgtaggagcgcacagctttgaagaatgcatcatcgccaagcaattcccgcaatgcatggacagtcagagcgccgcgcttgtagacgcggtcgtcgaacatatccttcgcgccggggttggccagcaaaatatccttcggcagcgcctccaggcctcgatagaattccaacgcactttccgcagccgacttaactccagctgcctcaaaccagagccattccgcgtaacaggcgaagccttcgttgagccagatgtcgttccattgggcgaggccgagtgagttgccaaaccactggtgggagagttcgtgggcgatgagtcgttcccaggttccttcgccggtggcgtggttggctccgaagctggagaggccttgggcttcgagtgggatttcgagttcgtcttcggtgatgactacgcggtagctgcggaatgggtaggggccgaagagtttttcgtaggcgtctaacatgtcgacttgtttggcaaagtcctccaaaatccgagcccgcaaggccgcatcccccacaggcacatacgcctccaccacaacgcccgattccgaaacgcccagggatacagtgtcgtattctccgacgtggacggctgcgaggtaggtggccatgggttcgcgggattggtagtgccaggtggtcatgctgccactgacgtgttttgagattaaatcaccggtgataatggcggcgtatccgttgtcggtgtggaagtggacgtcgaaaagcgccttctcgtcgggcgtgtcgtcgcaggggaaccagctcggcgcgccgtttggctgggcggcgacgagggcgccgttgtcgagctcttcccagccgatcatgccccattcgctgcgcagggggcgcgggttgccgcggtagcggatggtgagtgaaaattcctggtcaaccgggatttggttgcggaaggtgatgcgcagtttgcggccggcgtggcggaagcgcgcgacttggatgtgggtgccggcggtgcctttggcggtgactttttccacgcgcaggctgccgccgaggtccagggtcagcgcgtcgagcgcacggtaattatccatgtgcagcgttgcggtgcccatgagcaggttgggtgctacgcggtaggtgagatcaagctcgtagcgtcggatgtggaagcctaagttgaaatcaattcctgtgtaggaatcgcgtgtaccagggaccggggtggagcgcagccttcgcataatcataggtattaaatgctaccctgctgatccaaagtcttctcgatccaggtgtagatcagcgattccacaaacgcggtctgcttgttatccgccgcgccggcatggccgccctcggtgttttcgtagtaatccacggcctggcccgcatcaagcaaagcttgagcaaaaaggcgcgcgtgcgcggggtggacgcggtcgtcccgggttgaggtcgtcaccaatgcgggtggataaattcgcttctcgacgcccaccaccgcctgcaccggcgagtactgctcaatcaccgcccgttcctccggatcgtcagggttgccgtactccgccatccacgaagcacccgctgaccaggtgtgatagcgcaacatatcagccaacggcacctgcacaactgccgcaccgaatgcttctgggtactgagttaacgcgccacttgtcagcaaaccaccgttggatccgccacgaatcgcaatctgctccggcgttgcgtagccgcgctccacaaggtcggcgagcaccgcgcggtgatcctcccacaccttcatgcggttcagcttggttgcctgcgaatgccattccggaccgaattcaccgccaccacgcaggttggcttccacaaagtagtagcccttttccaaccatgcgatgccgcgggtcggggagtggcttggggtaagggaaacctcgaagccgccgtaggcgtggaccagggtgttttgtggttcctcctcgaaggctcctgtaataaagtacggaatcttcgttccatccgccgaggttgcccaatgctgacgagtctcctgaccagcattttcaaactgcaacggcgccttcttcacagcctcaagcgcaccaggcagctccgcacgcagcaacgttggcgcttcggtgaaactcgctgcctgcacccaaatttcatcgccatccaacggggaggtagcaaccacatgcgcggtgacatgctctgggaggtcaatgtgttcatgctccgttgtcggatcattgagcggcactgtgacgatttctgtggagacattattaaggagcgttaaaaccaggaaattctttgtcgtggccaatccctgcagcgacgtcgactcagtaggcgtaaacacaggctgaaaatcgcgcccgccctcaaggaactcctttaacagcagcactcccaagccacctgctggaatcccagcgaaatccgtccgaggactcacaaaaatccactgcttcttcacaatgacatcgcaatcggtcggcacatcaagcttgaccaggccaccctcggtttccagcgacgtctccgaattatagaaatccaacgaccttgacacaaacgtccgctcaaaaccaggtgttgaatcccgccacgcatgagtcgccacatcctgacgcgacccctcaaagaacaactccgcctgctcaagcggagtcccacgcttccacgtgagcacccgcgccgggtacccagaatccgtcagtgacccctcgccggtatccgtgcccaccagcaacgtatccagatcaacccacgtgacatcggacttcgcctcctccaattcaaacggcgaatcatccacgaaagcagccgtggccagatcaaactccctaatcaccgtcgcatcagccccgccccgcgagaacttcaccaacgcccgatcaaactccggcgagcgcacaaccgcgcccttccatacccagttttcgccctcatcctccgccaacgcatccacatcaatgagcacgtcccactccggctggtcactttcatacgactccaacgtggtcgtgcgccacactccacgcggatgctgcgcgtcccgccaaaagttgtacagcttctcaccgcgccggctcacgtaggcaatgcgatcatcggtgtccaacgcagccagcagcctggcttccagggcgtccttggctgggctttttagcttttcgacgctttcccccgaccatttttccgcccacgcgagcgcttccggggtgtcaatgtcttcgaggaacgtgtaatcagtcatgaagttcaggttagtgatcttttgaccggcaggttttttaaggcggcttccgagggcgcctccaattggatcagccgacgtaaacgtgaaccgagtagtaccggccgttttcaaaatctacgcgcactccgatttccccggtgtctttttcatcatacgggtttggccctgaattgtaacgccagcagaataaggaatgtagattcggctggtcacaagtctgcaatgaagagcccctaaaggagcgctccccgcatcgcgggatggactcttctgtgtcggtggttttgtgtacccgatttcttatactttgggcagttaattgttttgatgaatgcggtgccccaagtagagcgatagtctctttgcaagccagactctacggataggcagcttaaaattacatatgaggcggtgagtttactcaactcaccgccttaaaaggcttagatcaagggactcatgacctccgaggccctaagagtcttagcaactcccgaagatccccaaaacccaaactacctagggcgtgattcgcagccgatgccgtcgcggtcgcggtcgaggtgtgtgccgtagcctggatcgctttggcggatggaccttcccaggacgttccatacttcggtgcagtttttgtaggtgcggttggtctgtactggggctggagcaggcgcgacaacctggggagcgacaacctggggcgcgactgcctgaggggcaggagcgggagcaggtgctggggcaggcgcctgaggtgccagtgcagggggatttggaatgattcctgggaggggatttgggatcatgcgctgttgtactgcccagtgcacaccacttgcgataagtccgccgactgcagcgatagctgcgatgccgaagatgatgtcccggttggagatgtcagaatcttcggaatcctctgaacttcctgagcttgtgccgctgctcagctcagatgacacggaggcgtcagtgtctgtgtccacggtttgcgcctgcactggtgagatggcggaaaaggcgatcgcggtggtcgcgagcatggtgatgagggttttacgcatgccaatcatctttgcacgagctgtcaaaattattactattttctgtcagcgctccccttttttttgggtgtataggagatgctattttccgggcatctagcgcgcaggcaccccggtaagctacatgtccggtgcaagctttttgcttatcgacgccccctcaaccacaatccacccagccccaatgcaactttatttagataccaaccgcattatatttacctcgcggggagacgaaattaggttgggttggatgaaaacgatttacacacaatgccaccggctgttcattatctatgcaagatggaattaatttgaaaatctttaggatgaagttgattcggagtgtttataactggctgggatagtgtcagaccccggcaactgtgacgtggccgattggttaccaaacactcttgttcagaagcttctgggctaaaagagagttgtgtaatgccactttcacacatagccggtgagtgctgtaaatgattacggggaatttaactattatgctctttatcttccgtttttctggtggtcagagcatcatcggcaagcgcagaaaggtgaaacaaactggtgaggagagaaccatagataggccacttctttgaagttaattgttgatcctcactcatctcacttgaaagtttagagagccggtcgcggataggatctatttcctgattcggatctgcgagcaaagctccggcatcgtgcataagggatacccactgttgctggaatactggatcccagtcggaatctataatcggggtatcacgaagagtacgggcaaggtggcgtaaatgagcgatcccttcatcaatgctggtgaggtttgattcataacttgtttccgtaggctgggggcggccctcttggatgcggattttacgaggattaactcgacggctttcgcgagcgaaccgcacggagtgccacgctttttctaggtcattgttaatagaattaatttcttccagccactcatctgcattgtcgatattccacttttctgcaagctcatcggccattttttgtaaaacctcacccatcctccgatctaagtttcctaccaccatgtttgcctcctggtcgcgtaagggaggaaagatgatgaggttgatggctatggcaacagccacgccgagcaggatctctaaaatacggtcgtatagaaggggttgttgatcatcaaacccggaggcaagaagaaaaatggatgtagtagcaatacctattccttccgcgcggagctttggtactcgtgcacctattaatcctatgaccattgcaaggccaaaagtccacacactgacgtctaagtaagtgcctatgacaaaggaaagtccaactccgatgacagaagcaattgcagtctgaattccactgataaaggtgtggtagacggtgaattgcatcgtcattaacgctacccagggagctaaaaagggtagttgggagttaaggaggttaaccgaaatccaccacgtgactgtcgcagcaagtgctgatttaaaaacctgcagtgcatctgattggactgcgggtgagcgaattttttccattaatggggtggttatttcagccacgagtctctcttcaacggggatggttttacagaagcctatccgagttcccgtcgaaaaggccgagcctagtatggcgaggcaataaagatggcaaaaccggctgccttttatatctaaaaggcagccggtttcaatgttaaatctgtttctaggcctctagctcaaacgcacgagcgaaggtggtccaagatccgcggaggtcatcttgccaccagccccatgagtgggtgccggttgggcggaggttccagtcggctgggatgccggcggagtcaagttttgccttgaggtcgtgggtgcacttgttggttgcagcttcgatgatgccgccggttaccacagtttctgccattgcgatggactgaacttgttggttgagtccttcgaagcgtgggctgtcgacggattcccattcaccagcaaggccggatgcgttggagacgtatagttcggttccgcgtagtttgtcggagttgatcagtgcgtcgttgtagatgttgtattcgccaccacgtggtccccacatttgttctggggttgcgttgccgcggtcaagggtgagtttgaggtattcccatgggagcaggcttgaggttgctgcgcatcctgagaaggatgctgctgcgtcgtagaagcctgggaagtgttgtgggaagagtagggaagtagttgcggacatggacatgccagcaattgcacgctgaccgtcagtgttgagcttttcttccaatggtcctggaagttccttcaccaggaaggtttcccacatttgcttgccaccgagggacgcattctcttctacccagtcggtgtagtaggaaaacttgccttccattggaataacaacgttaacgttcttttctaggtagaaatccagaacgtcagtctgcataacccagttagcggcaccttcgccaccgtcgccaccgttaagaaggtaaatcacaggacgaggacctgcggactcatcggcagttataactaccagtggcacattgcggtccatggaaggggagtatgcccacatttctttgacgcgctcgtctgctgcgttgacgtgtgcgcgccagcgaggtgcagaggcttcatctgcaggagcactatcggagatggtggatagtgcagtatcgccagcaacgtctgctggggttacttcggcagcgcctgcggtggatggcgtgacaatggtggacatcgcaattcccagcgcgatggctggtgcagcgatgcggcgaagaagcttcatacgtctttccctcgtgaacttgtggttggtagccctgacctcgccattacatgaccagttagggactgcagggcctaaacccactaatcgacaatataaaccaaagctgtgtgttcagcccgttgtgggtaaaactagcagctaaaagttgcgccaaagattgtggtgcacctttaatttacatctatatttcaagctattacgttaacaggcgctttaccttttcgaaataacgagccaaaaatctctgaacccaggcacaacctccaatcccaacaaacccagcgaacacccccaaatcaaaacccagcccaacccatacctttaaattcagatcctcacccctcacagagcgtccaagcagcaccccaacaccacccctctcaaatagccccacaccccacaaacgcctttggagtctaagaaatgctaaggtcagcccaaaaactacctaaaatctccataagagtaacgcctgctatgtctcttaaatttcatgtcctgccccacaaatttggaaattgcgctgaactaaaatcaatttcaagctaaattaaggaacctgagcttctgacctattcagcgctggattttttctggcattttcttggcagtcagtgagttgctaacgttctattggttaaaaattgatctgcaagaggactgcaaaatatggaattaagggaatacgcgacaatcctgatgaagaattgggtgttgatcgttatcgcatccattcttggaattgcagcgggcgctggtttttcccttctagctacaccggagtatcagtcacgtactcagttgtatgtatcggtgcggtcgggggctgggacaacctctgacatggttcagggtgctaacttttcgcgtcagattgtgaatagttatgttgatgtcattaagacgggtgttgttctagagccggttgttgatgagcttggtctggagttgacggctaaccagttgagttctcatatcagtgcggcttctcctgctgatactgcgttgatcaacatcactgcttctagtccttctcctcagcaggcggctgagatcgccaatgcagtgggggagagtttcaagaatgtgattcagactgaattggaaccagactccggcgatggcatgagcccgattaacctgactactactcaggtggctctggaaccatcttctccggtcagtcctaatgtgatgatgaatatcctcctcggcctacttgtaggtcttgcaataggtgttggtattgcagtgcttcgcgcggctttggatactcgtattcattccttgcgcgatattgaagaggttactgataagccacttttgggcggaatcattgcggattctgaagttgagaagcacccgttgatcattaagcacaagccgcatagtcctattgcggagtcctttcgtgcgttacgtactaacctgcagttccttaacgtcggcggctcatcttcagtatttgttatctcctctgctaatcctggtgagggtaagtcaaccacttctgtaaacctagctttggcgcttgcagaggccggctcccgtgtagcgctgatcgaagctgatcttcgcttgccacgagtgagcaagtacctcggagttgagggcaacgcaggtctgactgacattctcattggcaaggccgaggttaatgatgtgttgcagcgttggggtaggactcagttgtactatctcccggcagggcgcattccgccgaacccgagtgagttgcttggttcagctgagatggaaaaggtcattgcggagcttgaggaaagctttgattatgtgatcatcgatgcccctccggcgttggcggttaccgatgctgcagttattggtcatggcaaggctggcatcctgattgcggtctccgcaggttctacaaagaagcctgagttggaagctacgctgtccacgcttgagaatgcggatgccaatgttgttggcgttgtcgctacgatgctcccgcctaagtctgtggctggttatggctacggaaattacggctacggcgacacctccaaaatcaatgcccctaagcccgacaacaccgaactaaccaccaccgatgcttccaaggccaacaatgagcaatagcttcactattctcactgtctgtactggaaacatttgccgctccccgttagctaagcagctacttgaacttgagcttccgggggcagatataatccgcgttgattccgccggtgttcaggcgatggttgattcgcctatgccggagcaatctttagaaatcgcacgtaaacagggcatagaaaaccctgaggagcaccgagctaagcagattactgaggagcttgtaaaccaatctgatctgattcttgcgatggatcgggggcatcgaaaatccattgtccagctaagcccgcgtgcaacccgtaaggttttcactgttgttgatcttgccaggttaattgaggcaacaactgatgctgatctgcaggaagagctcaatctggcaggggattccgtgatcgataggctgcatgcgacagttgaggctgctcgtcttagccgcagtgaattgaatcctctggataacctcgcagatgaagatattgttgacccgtacggaaagagtcaatcggtttatgaggcatcggcgagtcagctaattccagctattcgtttgattgcttcttatttgaacaaagcactggagtctgcgtaatggcgaggaagtatcgggtgggtcaacgccaacgtggttggtctatatggttaagcattcttgttattgtcgtgcttttggttggggctggagcgctttcggtttttgcccttaaaagcgtaaaagaaaacgataaaaacgaaggcttttcgacgactaaagctgcctccgtagagcaaataagctctgaaacttccgaagaaagccccgaggaagcaccggcagagatttcagagtcggaagaaatctctgctgagcaggcctcgttgccactcgtggcgccacagcggcagattgcacaatttgaaaatctagctgtgcgatcccaagttggtacgtgcactgatcctggaacactcgaaatctccactgatggtggacaagcttggtccacatcagcgtcatttacagcaaccacggcgacacaagtgcttcgcttgattccggtgagcacttcaaacatctttgttgttgcactgaatgctgattgcgagccacggatttacggaacaactgatcaaggtgcaacgtggcaacaaccagtttcagcagtaggaacctggtacttagatccttctaacccaacgcagctaacggctcccggtggggctaaagcaattagctgtgaggcaatctcgatcgccccaagaactgacagcaacgttgatgtgctgtgtgcagatggatcgctgacttccacctctgatggaggagcaagctggtcagagcccgttgcgggtgctggtgtatttaatgtcgcgcactcaaatggtgattggttgctgatcgctcaagaccctgatcaatgcacaggaatccaactaagtgacactcttcctgttgctgagggagctacatgcgtgcatgctgaactcggtgaatccgatgccggacagatcgcagcaactcaatttggagattcagttttagcctgggttggcgaaacccaatttatttcaaaagatggtggacaaacatggcaataagcattggtaaagcaggacagaacttaaaagggtcagtgcctatcggaaaagtcctttttctcattgatgcccttgcctggatttctgcactatttatcggtgtggttttgcggtatgaattcaatctgagttctatcaactggagtgcgtttgcatggttcgggcttgctgcagttattttgcagtttgttctcggactttctctccatctttaccgcaagggattacgtcaccttttcggtagcttcgaagatacactaaacgtttctatctcggtcattgttgtcggtgttgtcctttggatcgcctcactatttgttggtcagcgttgggaaatctcacgcggtgtcatgctgctagttatcccgcttgctctcgtattcgtattggcagtgcgttatctcgcgcgtatgcgagttgagcgtcttcgtcgtccggctgcggattccacaccagcattgattcttggtggtggatacatcggtaccaacctgatccagtggatgatgtccgatcctaagtcgcctttccgcccagtcggcgttattgatgataaccctgaattagcatggcaacgcgtacgtggtgtgccggttcttggcaagtttgatgatatcgcccaagttgcatcagacactggcgcagaacttcttatcgttgctattggtgatgccgactctgcacttttaaggcgtgtccaagataccgctaataaaaatggtctttcagtaaaggtaatgccggctattgaccgcgtcgtttctaagggcgttcgtggaaacgatttgcgtgatctctctattgaagatttgcttggacgtcaacctgttgaaaccaatgtttcagaaattactggctatctaacaggtaagcgtgttcttgttaccggtgcaggtgggtcaattggttcccagctatgtacggaaattgccaaatacggacctgctgagcttatgatgcttgatcgcgatgagactggtttgcagcaggttctgattaacgttgctggtaacggtttgttggatacggatgctgtggttcttgcggatatccgcgaagcagacgcgatgaaagagatttttctcaagcgtaaaccagaagttgtcttccatgcagcagcattaaagcacttgccaatgctggagcagtatccagatgagggctggaaaacaaacgttctaggaactcttaacgttcttgctgccgcagaagctgttggtgttgagactttcgtcaatatttccaccgataaggcagctaatccaaccagcgtcttagggcactcaaagcgagtcgctgaaaagctgactgcctggtatggacagaattccaccagcaagtacctatcggttcgatttggaaacgtcattggtagccgtggatcgatgctcccgactttcaccaggctaatcatggaagataaaccgctaacagtgacgcacccggatgtcactaggttcttcatgacaattcctgaagcttgccaattggtcctgcaagccggtggtattggacgttccggcgaggttctcatccttgacatgggtgagcctgtaagcatccttgaaattgcacagcgcatgatcgcaatgtccggtaaagatattgacatcgtgttcaccggccttcgcgagggcgaaaagatgcacgaagagctggttggtgatggtgaaaccgaagatcgtccattccactcaaagatttcgcatgcacatgcagaaagcctcgctcctaataatctcgatagagatcgatttatgcaacgtgctggaaaactagcttcaacagattcggagatcatctaaatgactaatgaacgaatttttctatcatcgccagatgtaacacagttagaggaagacgcattggtacgcgcaatccgatcaggatggattgcaccgcttggtccagaagttgatgcgtttgagcaagaacttgctgagtattgtggccgcaaatatgttgttgcactttcatcgggtactgcagccctccacttaggtctattagcactaggcgttggagaaggagacttggttcttacatcatcaatgacttttgcagcgaccaccaacgcaattgtttatacgggtgctgagccaattttcgtggactgcgatgaatctggaaatatggatccagatcttttagaaaaagcctttgctgagctaaagagtgaaggaaaggaagtaaaggctgtagtacctgtcgatctacttggcaaagttgttcagcacgagaagattaaaaagattgctgatgaatacggggcagtagtgctttctgatgccgctgaatccttgggcgccattcgcaatggaaagtctgctgcagcatatggagtggcggcagcggtttccttcaacggaaacaaaattatgactaccagcggtggtggagctttgttaactgatgacaaggatattgcagacaacgtccgctatcttgcgacacaagctcgccaacctgtagttcattacgaacacaccgatgttgggtataactatcgcctttcaaatatcctcgctgcactgggacgagctcaactttcccgactcgacaagatgattgagcgtcgacgtcaacaccgtgcgttctatcgagaattgtttgcaggtgtttctggagtagagatctttggcgagccatcaggggtcgatggtggcgacactattgataatttctggctcacttctattcttattgataaagaagttgcgggatttagctctgaagatcttcgatcagttctaaatcaggcgaatattgagtctcgtcccttgtggaaaccaatgcatctccagccagtatttaagaagtatcgtagcttcaccaatgaagaaggacagaggctatttgattcagggctttctctcccaagcggttcagtacttgataatgcgtcaatgaatcgtgttgagactacaattggccagtttttggagagtcagcatgcgatctaagtacaaaaactatggcgtagtaaaacgtgcgattgatattggggttagtggcgtagggctgattatctctgcgccgattcagctggcaatagcagcagttgtattgagagctcatggtcgtccgattctatttcgtcaaccacgacctgggaaagacggtgtggtatttgagatgattaagtttcgaaccatgcttgaaccagatgaaaaacatgtaactgatgaacagcgtctaactaaagttggaaagcttctgcgggaaacgagtttagatgagttacctacactctggaatgtatttaaaggtgatatgagccttgtagggcctcgacctttgcttgttagctatctggaacattactcttctgaacaagctcgacgccatgaagttcgtcctgggattactggtttggctcaggtgaatggccgtaatcaaactacttgggatgaacgacttaagttggatgtcgaatatgtggatcgctgtagtttgaaactagatttcaaaatattaatcgccactgtaaaaacagttctttctaaaaagggcattagtaatgaaggtcatgtcacgatgccatccttcattgaagaaagaaaatagcaggtaaaaattttactttctgtatagagatgcgccaccaattttggtgcgtaaaaaggctcgaccctgagcaattcttgggctcgagtcttcttatagtttacagatgtaaaatattttgcatctgagcagttagaaacggtatgtcggtagtaaccgatacgatttattgaagctatttagtaattgaggacaggtgtgtcaatgatactaagaaataggtcacgttgtagatcttctagagagaatgtgattctctttggggctacgacagacatgtcaaatattttttatgaagggatcctgcagaatctaattcaagatgggtgggatgtgcaccttgtttcaaatccaggcccagttgggaagaaattactgaatggtaaagctcatactatcgagatgtctagagagatttcaataggtaccgatgttaaatcattatttaattgggtgctattgcttaggaaaattcgtccaagagtgctgatagttggaactccgaaagcttcattgctgggagtcgtggcagcacgaattgctcgagtgccacgaattgtctatgtggcacatgggctgcgctctgaaactgttttaggcttaaaaaagaagattctagtgtttttggaatatttgacccagttgtttgcacatcaaactttggctgtaagtcattctctgaagaaagcaattgaagatgcgcaccctcgttttaaaggaagagtgcaagtcttaggttatggcagtatgaatggagttgagcttgatcgctttagagttccatcccttgaagagaaattatctgctcgtaatgctttaaacctgcctagtaaatctgtcattgttggttttgtcggcagaataaataaagataagggaggagatcttctcgctgctcttacaaaacatgaggcttttacccgattgcgactgcatctcttaattattggtgaattggaagacgatgacttgcgagaagcattcattaaattagttaatgaagggcaggttacgattacaggatggattgatttccctgaagaaccattagctgcagttgatgttttgcttcacccaactcagcgagaaggtttaggtatgtctttgctggaagctcaggctatgggagtgcctgtattgacgaatgctgtgactggaacagttgatgcagtaacaagtggagaaggtggcttttttgccgatgacgattctgttgagtcctgggtttctaagattgatttattagtttccgatcctaagttaagagaccggatgggacgtgctggtcgccagtttgtgtcagctcgtttcaatcgtgatgatgtcgcagctcgtttcagtcatttcgtggaacaattcaaaaaatagggctcattcaatttcaatattcagataaatgggaaggggttcttttttcaacttttacctattggtgcgaagaatcagatccaccctattgatctgaacattaaaacgaaatgtagctaatttagatcgcgaatttatatggaagaagaccgatggcaaatactagagatgaagctactgaagtacctgaagatggctctttgaggaagggcgcagctcggggatccgctatcactttagtagggcagattacgagaattttgattcagttactcagcgtaatcttactagctagattaattcctcctgcagattttggtttatacgctatggtccttgcagtttcaggcgtggctcagatctttctcgatctagggttttctatggcggccctgagatcacgtgatctaactaagcaacaacattcaaatctattttggattaatacttccgctggttttcttctatttattattattttttcacttgcgattcctttagcaactttctatggagatgatcgattaataagggttacacagtggatatctattgtgtacctgttggggggaatcactgctcagtttagggtccatttaaatcgtcacctgcgatttggagctttatctcttgcagatgttttagcaccgttggtagctctcgtagtggccgtaattatggcaatgaagggttatggagttcaagctcttgtggttcaaacaatattgaactacttagttatgctggttttggttgtcgtgatggcccggtgggttccgagttttcctcgtaagactcccggtatgaagccattgcttacttttggtatgggacttggcgcgactagattcttatcttatttaactcaaaatattgatagtattattattggccgggtgatggggccagttcagctcgggttttatgatcgtgcatttaggctggcagtcgcacctgttgtgcaaattagtttcccattcacacgtgtagcaataccatttttagttcgtgtaatggatgatggaaaaaagtatgttgccgcactacgtgaagctcaaatggtcggcatctatggaactgctagttttcttttggtttttggcggtatggctacaccaattgtgaccttaatttttggtcctgattgggtagaagcgggacttctgatgacaattctatgcataggtgcaatattccgtacattgcaacaggttgctacttgggtatttatgtcaaaaggactgtccggggcattgctgaagctaaatcttgtcatgcaaccggtgatcgtattgttaatcatcggtggtgctcgatggggcacggttggtgttgcatgggcagggactctgggatactttctgttttggttggtctcaatagcttgggcaagttatgccactaatttaaatttgtggagtttagtcacaaatcctctagagattatcggtaaatttagccttcctgcggggcttattacttttgcgatttcgtcaaattcatccctttcgctattaacacagttcttggcatctattggtggtgcattgatttggtttgtattcatttattgcatctcaaagaagattaaaaaagatattcgccgactagttggaatcggaatgctagttttaaagaggcgttgaggggtagtatcgcgtaagtttattagtggttagcgtagatttttcgaattgaagatgtttctgaaaggtatttagatatgtatgcagaaattaatggcggttttattccagagggcaccgtgcgggtaagcggcgcaaaaaactctgctactagacttctcgcggcggcactgctaaccgatgaggtggtgcatcttggtaatttcccaaccaagcttgtggatgttgaacataaaattcgctttattgaagagcttggcggaaaagtgcatgtcgaccatgatgagcaaattttagtagttgatgctaaggatcttgcagcgcgagaaatgactactgatgaactgaatattccgattcgaactacttatctcctagcagcagcgcagattgggcgtggggaaattgctcgagttccttttcctggggggtgtgctattggaggaggtcctgctggcggacgaggatatgatcttcatcttatggtctgggaacagctaggttgtaaaattcttgaaaaagatgatcacattgaagtaactgcaccccagggctttatcgggggagttattgactttcctatttctactgtgggaggcactgaaaacgcgttactatgcgcaagtattgcttcaggggatactaaaattgccaatgcttatattacccctgagataactgatcttattgaacttctgcgacgtatgggtgcggagatcactgtctacggtaccagccgtattcatgtaaagggtcgagcaggtcttttgcagggcgcatatatggacgtaatgccggatcgtattgaggcattgacgtggatcgtgtatggaattatttcaggcggaaggattaccgtcgaaggtgttccatttagctcgatggaagttccttttatccaccttgagaaggctggagtggatcttttccgtaattcaagttccgtatatattacaccagaatgcttgccttcaggctcagttcagccatttgagctagcgtgtggaactcaccccggagtaatttcggacatgcaggcactttttgttcttttaggattaaaaggtgcaggaacttcacgcgtctatgactatcgatacccagaaagaattgcatttgttgaggaattgacaaatctagtttcgggcgacaaattaagtgcagaggctggcaagatcactatccagggagatgctactttccggccaggatatgcgaactcaactgatctacgtggttctatggctgttgttttagcggcgctttgcgctgatggaaagtccacgattaataacgtccatatggcgttacgtgggtacaacgagttggataaaaaacttcgtttacttggtgcggatttaactatcagagaaggcgaagttccttcaccttaagaacgaaagttttacattgaatgattttaagaaagtctccgaaagtcttgagaccgcattgcgtaatgagttcgactttcggttcgctaccgaagtctcattgaaggagatatcgcgttggaggatcggaggtcctgcagctgtatttgctgagcctagttctattaatgagatctgtgctcttcttgcattcatgaaaaatcgtccggaaccagtagtagttgttggcggtacttccaatattctttttgattcagatggctttggtggcttagttataaagttgggtgaaaattttagcaactttataattgaaggcagccgtattcgtgctcaagctggtgcttcggtacctcaactagtgcgtgctgttgcgaccgaggggctggaaggaatagttcatgcgggcggaatacctggaactgtaggtggcttagttgttatgaatggcggaacccagcgtcgtggaatcggtgagcatgtcactaaagtattagtaacagatgctgaaggcagtatccgagaactgaacgcaaatgaattgcagtttacgtatagaaactccgtacttaagaactctgaaactactgtattagaagtcgaacttcttctgaagccaggaaatgctggagaattgttggccgaattggaaacgattctagatcaacgttctcaaaagtttcctgaggatcttccaaactgtggatcgacattcctttcagatcccgctatgtacagtattgttggtcctcctggtaaggccatagaagatgcaggattaaagggacttagacgcggttctgcagaaatttccatgcaacatgcgaattttatagtcaatcatggggatgcatctgatgatgacatcttgtggttgatctctgctgttcgaaaggaagtttatagcagaactggttttgtaatggattgtgaagttttatatctgtcatattctggtgattttcgccctgctcatgaagtggcggacgagcaatggcccgatatagatttagtaaggaactaaaatgccaaaagtaagtgtggttactggtttttataaccgctgtgagcatttagaacgaaccattgagtctattcttaaccaaacttatagcgattttgaattaattgtttttgatgatgcatcgacagatggaacagcttcacgattgttagagttaaaagaaaaatatgatgatccgcgtttccgatttatcattcatgaagagaataaaggtttcgtaaaagggttatcagaagcaatttctggagctaaagggcagtatattgcagtccagggatcaggcgatgtatctcttcctcgccgtttagagcttcaggtagagtttctagacgcgaatccttcggtaggtgctgtgggtggtgctatctataatattcaagaagatacgggaacacgcaacccacagagatttgaaaagccaattgctacattcgatgatttattgacatctaatccgttcactcacggagaagtgatgtatcgcttagacctttataagagtataggtgggtatcgaagtggctttacttttgctcaagatcgtgatttatggttgaggatggcgaaaaaagcagatctgggtatcattccagattttctttatcaccgttacacacttttagatggtgtctctttcgtcccggataaaactatacgtcagcgatgcttttcagaagctgcggtgcgactggcattaatgccagaagaggaaggagctttagcctactctaggctggaagctgaagggcctactgccgtagttcctatcgctgatagagctgttcagaaatttgtccctaaagcggctattcgcttatgtctatatggtgctccggaaactggtttacacatggctcgagactatatccagaaccctctgcgccgtaccatagttgtagttttgatcagcatctattcgtctagattaattaagcctcttcaagatattctatataagtctatttttaagggggtctcgatttctaaacctattaagagttcactcgtgaagtttacaagaagaattcaagggaagtagcgaaaaaccgcatctaccaaggtagtctaccttggagcgcaagttcctagtagtgctttgttcggagagtacggacacagtatggacaatagtccaacaacctaatgcagcggtctggtgttgggcaagtatgacataataaaaacttactccgccttgcgcgtgtttgggtcggcagccaaccgttgggtggtggcaaacagatgcgccagggtcactaacaccgtgtggtgatcctagtctaaccagctgcacccggatctgacccctgtttggccgtcacctaacatcccaacaacaaggaatcgaaaggcaatctgccaccttgccaagcaagtcctacacagaggagttcaagctcgacgccgtcgccttgtacgagatctccccataggtttcaatccgcatcatcgccaccgacctcgggatcagccggttttgtcaatattttatctgccaaaagagcgcgacgggttcagctgggcaacacaacatgtaggagctcagtgtgaagatggaggttcctacagaaccatctgaacacgctgggatccacgtcttgaagcctactgggaacctagtcgcggacactccgataaggtgcgggaccacatcctctgctggctcgttgatcttccgtcgtcgacttccgcatccgcctggatgcccgcgtactccgcttcctatgcacagctatgtcgtgtacgaggaagatcttccacaaatcctgtactgcgcggatgactgatccaagttcaaccaccggggcactgctagatcttgcagcgcttggtgattgacggatgagtgtgtctgccacggctaaagcactgaagatcggctgggaactagtcaaccaggttgcactcgatgcttgccgacagctcatttacaacgacccgcgccaccttgaagtcgatgaacatgtatggaagtatactcgaaagccaggttagccgtcgaacctggtgaccatcttcgtcggcctcacctcgctgggggatggggagatggcctgcttgactgctggaggaccgcccaggccgtactgcgtacctggctgccggaacgcgaccaaagagtgatggatcgctttcacgtagagcatctggcgacggacaatctcaccgggtgccagcagtgactttaacgagagaccaccggatcccgcgggcacaaagataaccccctgtacaaataccgccgtacgcttttgacctggaagaattatttcacgcagtggcagaaacgaggactcgtcatgttgtgggccaccgatgatgactacgtggctttagatctgacgtggttgttctatcaagacatgattgcggcgtatgggaatccgtagaaatcagaggaaaagaagctgatgagaaggggatcaacagcctgcgcaaaggcctaccagcgagaatggacgagcttgcccaactggggcacaccttgtggcgtcggcgtaagaacgtgttggcgtccttcaatatcggtgcatccaacggacctgtcgaggccatcaacggcagacttgagcacctgcgcgggatcaccttggggttcaggaacctcaaccactacatcttgcggtgcttgatccaagccggacaactgcagaggaagatcaatgtactctaaatccgaagagttggcaaagatcatcgttgatgaagtcgtcgaggtcaccgcgggcgcgagaaacctgtgaggtgttcatatctcaaaaattacgcggggaaggagacccgcggacgagagctgacaaagcgctacttgaacaactacctcttacttaaaaggctcaccatttgaggcaaccaactcattccataatgcgctagagagactacgagcatacgtagcggtcaaatgatgtgaatccctgtataccaaaacatttccgataacagcggagcaatattcttccggacaaatccaattactcaaatccaatacaggcacgtctatattttgagctgcagttttttgctgaggatgagcttcagtcccaagcgcaacgctccggtgaactgaacattctgagagattatcgcggtttgatgctacacattctgggatatcaatttgcggccgaggagtatcaagaagtacagaaatagaaacacctgcatcttttaatgaattccatgccatttcatatccttcggaaacggttcccgtcgcgacactatcgattaacggatttgcagaagcgtaacgttggctacttacaatcacatgatttggtgcagaaggtccagttagcttagcaagtaatttttcattccactcatagcattctgcataaaaagtttcaccaagtttgatcgcagtgcttatgagtggacactgtgactttgtataaacttccaatctccacccctgtgcttcagcaattggttccaaggcaggaagccaatgaccagcgtgggagtcaccgacaagtgctacagaaaaatcagaatttttatcaccataaacacatgactcaggactagtctcattgacttcttggtgacaacccgctgcatagttacttgggtaatctcgttttgccttagcagtcgtcggataaaaattatctactcgatcaacaacctcaccggcatccggatccactgtcaacgcctcagcgccaaacagattctttgctgcttctttttccgactccttatttacagcggttggatcatacggggtcaaactaaattggggtggcgcagcttggcttctatttggagataaaaagaggaggatcccagcagtcgccgataccgtcatcaaaataactccaaaggccactgcttttcttgcgtcagccttgattgctgaccaattacgcattggattctcaatgaaatgataacttagccaagcagggatgaaagagaacccgataattaggagaccttgccaaaagtgcatttctccattgaaataataaatccctacaacgatcaatggccaatgctatagataaagcgaataggaaagatctccgatccaacgcataggtttaacttttagaagtacacctacacctttttccgcacgacctcccatgccaccaataattacagctgctgcacctaatgttggcaccagcgcggcatagccgggaaaaactgtctgagaatcaaaagtcactccagctgctacgatgcttgctaatcccattacaccaagcgcatatcctatcggagctgaaattcgttctaattggaatgaaaaagaggcgagaatcgcgcctattccaagctcccacaggcgtgtcgaggtaatgaaatatgcgggtgccggattggtgtatgaaaaataaatggaaaagcaaagagaaactaacgttataagtacagctgctaaagcgatataacgctgcagccaacgaactttgtttagtttcgtgccactagtttcctctgagtccagtgtaaaacgatgccgactgaaatacaacaacccaataagtagcgctggccagaggatatagaactgctcctccacagataaggtccaataatgctgaactggactggcagcagcttctgcattcaaataattcgtatttgaggcaaaaagccagtttaccaaatacactgaacttgcaatgatctcagcaccgataagcatccaccgggtatcaggcaacactaaaatcgtaattagggccgtgaataccaaaacggctgtggctgctggcagaattctcctaatccggcccgcataaaagttaattaaactaatttttcccttttctagacaagacctgatcaagtgtccagtaatcaagtagccagaaattacaaagaaaatatcaacacccgtaaaacctccggaaagcacggagccatcgccagcatgaaatatcaatactaaaagtaccgcgacggctcgcagtccttgaatgtcgggacggaaatgacttttcgaagcttgttgtttagcagttgccgtcgatgtagtcataaaaaccttccgtatgattctttaattctgaattgcaataatctaatcagttgaatgttgctggcaattttagcgtagacaaattgatttaaaacttcgaagatcatacgcttattgcaccttcgtatatgcattaaagatcgtaagctattggctgtaattgtgcaggaagaatatacatggatctggctcctgcttggtagacacctaatgtcccaacaatttgggacaaaaaggtaacctaccgatcatggcaactaagacctaatccgacgtcgttggttcaggatgcgttgatgatggctaaagaccaactagacatcgtaaaggatgctgtgttccactgaagaacatggcagtgtgtacacctcgcaagtattccaggacatctgcacaaagtcgggtggtttgtcagttgatgggtgctgtgggtatcggtgcggataattcgctggcttcagtcgtttaatgccgcattcaagcgggaagttccgcgcaggattccaagacgtttgcgaaccagttggtgtgccgtcgggaggtatttgaagtggtgtaccaggtacaacacgagtcttaggcaatcctggtgtggtcatctcacacctgcgatgtatgagattcggggttctgctatcctgaaatctgcttcttgattaaatttcctgtgtctactttccaggggtcaggccccataattagcgtctaaagtttttgccgtggattcttcatgcctctttaaggagaatattgaaaggttcaccacagtgttcaaaaaggccacaatattttcaaatcgtctctcctttaacttctctagttgctgagggcgaaatattaagtgaaactagaacgaggtcggagagtgtaatttaatttagtggagattgcatacattacgttccagcccgttgaaataaagccacaataaaagctagtaagctaatcgcaaataattgtattgcgaatcacctttctttccggccggaatcaatctcagcgttctatactcgtcaagggccttcgataaaacaaagacaattttcccccgacgggacaatctgaaaacttgctgtatcaataaaacacgaaaaggaatacttttatgaaaattgccgtcgcagggctcggatatgttgggctttcaaatgcagctctcctctctaaaaatcataaagttgttgcagttgacattgatgaagaacgagtgaaactagttcaagaatttcgttcgccaattgtcgatagcgatctcgaagaatatctgtccactaagcctcaaaacttaactgccacaacggacgccgaagccgcttacaaaggcgcagattttattgttattgcaacgccaactaattacgacccagagtcaaacttttttgatacttccagcgttgagtccgtaattgagatagtccttaaggtttctcctggatccacaatcgtaattaaatcgactatccctgttggttttacatcggaactacgcattaagcatccagaagcttcgattattttttcacctgagttcctgcgtgaaggccgagcattctacgacaatctctacccatccagagttgtcgttggtgatcgcagtcctctgggggaagaatttgcgactctgttagctgagggggcaaaagaaaagcctccgattctacttacggactcaactgaggcagaggcgattaaattattttctaatacatatcttgcactgcgagttgcttttttcaacgaactggatacttatgcgtctgttcgaagcttggatactaagcagattattgaaggggtagggctcgatccacgtattggatctcattacaataatccttcatttggatatggcggatattgtcttccgaaagatacgaaacagcttctcgccaactataaggatgtcccgcagaatctaatctctgcagtagtccaagcaaataagactcgtaaggactttattgcagaggatatcctcagtaaatcacctactgtagttggaatttaccgccttgtaatgaagtctggatcagataactttcgttcttcttctattcaaggagtcatgaaacgaattaaggccaagggaatcgaaattgtagtatttgaaccgaatctcggagaagaaactttctacaattcgaagatccttaatgacatcgaagagtttaaggattactgcgacatcattattgcaaatcgtccaaccgatgagctttctgatgtaccagaaaaagtttatacacgtgatattttccagcgtgactaagtggaaagaatcttttgttgatgacccgctacaaatcatgagtccctaacaaatcttcaactagtgccatacacgagacttgtgtagggcactaagtcattccagttaagtctacagctacacaaaacttgttttggacgtgtattttgaagcggcgtgggtaacgatcgtgaagcagcatgatgagtgtcgtgaagcaccaataaacgccagaacctacactttctaatacctacccccgacatcaaagtcgaggcggaaaattgaaaatatcggcacggtgatcaattcccggtcgatcacagccatgcactaacaaggtaattcctacagaaccattcaatctcgatgcggtgctgcacacgtaacgatctctaaagctcagaaagcacttgaccgaaattgatccgcgctttctttaaaccccacaattcttaacaagcggtactgcgattccgcgtatgtggtgtgctctatcacgaccttgtgcacaacgtcgcgatagagcacacccgctgcgcagaaaaccggtacgacatagccgaatacagcgtatgcggttgaaagccacctggcgttaaagcgtttcttactgattgatgctggggtgggtactgcttcatgatgtccactcaagtgcttcacgatcgttaccacgtcgcttcaaaatgcacgtccggaacacaaaactgaatcagcctgagtttttcggcggcaaagggtagaaaatccttttcgggtgtgttgcgcttgtcaagcaccccaaaacttgacgtgtggattcgtattatcagtttcatagcgtgttaaaatcaccttaacgaagcaatcgttgtcaatgaggagtaatagcagacaaagttaccactactttgctggttgtttattaacttttcttgattttgaagaatgggcattttggttagtggaagctagtgaagaggatccaataatgaccactaaggttaaacctatccaaaagttaaaactgacggccagactgcctgataccgaggaacaaatcactaagaatattagactggctcgtccgagataattgatttttcgaaagagataaatcaaggttgcaaacaggatgaatatagggagagcaccatatgctacccacatttcaagaaatagattatgtggtgacaggaatttatccgagctactaatcgaataaaaactatgcactttttccattccaactccggtcagcgggctggttagagctaggtcgataaattcttgccaaatatggagacgcgctacagagtcttcactgtaataaaatgattttatggcgtctctggaaagtataattacgggtcctactagcaaggggccccagactataattcgatttcgaactctataatcttgcaagcggtgtgtagaagattttgtagtgtttgcgtataggaaagcaactgcaagagcaataatcggcccccatgatagtgcacttagtaaacaaactagaaggatggaactaacgaaaagggtaaatttcggagtgcttcgtttggttatatgtagaagccaaaccccgaaaattgctaggcctaagaactgagaagcgaaaataggattggcaccaaatgctccggctttcaaatgcaaagctccgccaccagcaattcgtaataattctcctactccgtagattgatactccggttgaaaaaccccaaataatatgcggaatattatctcggaaagaactggttactaagaaaaggaagccagtaacaatggcgccgagtaatgttcgagtttctgatgcgctttcattatttatccattcgatgatgaaaatggcaggaatcagtgaaagaaaacctgagtacttggtaaaaatactagcatcaggaaacttcttctttcggaaaattaatataagcaggcatagaacaaggacaccgatagttaacgcaaagcctgctagagatggtgcaattccggggagggaatgccatacgccaactatgagacccgctacaaagcttggtagcgagagtatgaggattgtcgcaaggaaaattagacttccgacagctaaaggctcacgaagcacggaacatccttaaagtatttctggttattgacttgtgtaatgtgagtttcttcaagacagccccctcatttcttttactaggggcaacatcattgatgcacataccacttatcggcactgggcggactgttgactagcaggatgctacgaaatctttggaaaagaatagctagaccgatgttagatgcggtccggggtgtatcccgtcatgaatcctgctttacgcaaccccaagtatcgagtaacttgagcgccataccatataaaatttaagaatatttgtcgaactggtgaccgctttaagaacgaagcaagttccatccttcgttttagtatgatccaggtatatttcttaaatggggaggttttcctgctgtgctggccaccatgaatgcggtatgagctaaggctttcgtcaaggtatccgattgctccaattttggagagcctaaggaatagctcatagtcctgggatcgagtcatctccagagagtatcccccgatctgttcaacaacttgtttgcggtacataactgaggagtgaatgattgggttcttcactaacaggatttgtctgatgtcctgggaagttggaaggtcagctgattgtccaaagattttcccatgttcattaatgtgctttgtttttgttgcaacgcaaataatgtatggatggttcctgagaaattcctcttgcttggataagcggctgggagcagcgagatcgtctgaatctagtcgtgcaattagctgtccatcagacgctttgattccattgtttaagctcgtgggggtaccttgtctaattttttgctcgacaattttaatgcgttcatgttcttttacccattggggaacatccttaatgggcgccccgtccagaactaggactatttgccagttttcatagttttgttcgcaaaccgatttaatagattgactgcaatattcgtcataagcgattgttgggattactacacttattaatggagcggaactagtcatggtggctttctttgagaatatttttcgctgactgctttaatttacttgatgggcaataagcttacatcgaaatattgaagaatagcttctcctctggggcataagagaaagaggcaatttgcttctaattttgtttttgctctattgaacagggctagcttgatatctggctctgagcgggatttatagaccctttcaggatctttttcaaaatgtaattcatttatggttgcgaattatgatcgctatatgcttttagtaaagagaagatgtgttgaaggagaggttagagagataaggctctatttgatcatctgcagatagatacgtgttttcaagaacttgcaattaagagggaagatggttgctcaaaactcagtcgtagtgataggtgcatctggattcggtagggagagtctagacgttctcgaagcaatgaaggaagccggacattcgttagagataattggagtagttgatgacaatcctgctgcaatcaatttgcagcgtcttgcggagcgaaaaatcgaatatctaggaactttaaaagaatggattgagggatctcccaagtcgtgtaagtatgtgcttgcgattggaaacccaacgattcgccataagctttctgctcttttagacaagtctggtttcgatgcatttacggcggtgcatccctctgcagtgataggaagccaagtagtgtttgggtctggggctgttgtatgttctggggccgtgatttcgaccaatgtaaggcttggtgtgcatgtgcatatcaacccaaatgtgacaatcgggcatgattcaattcttgaagactatgtttcgataaatccggctgcaacaatttcgggtgaagtcctgatcatggaagaaactcttattggagctgcggctacagtattgcaaggactgactatcgggaataggtcgttagtgggtgcatcttcgtgcgtcactaaggatatttctgcagggaaggtagttaagggtattcctgcgcgctaaaaaagtagaaattatcgacctttaacgccattgtgattagtattttggcgttgcctcctgagcgacttgcaaatagttcatttcggcagagtgctaacggttaggcactattttccgttagttcttttgtagtcccgacgcatctaagccgaaacagctaaaagtcgcacagggccgtgtaatgcccgtaagagatatttaaggaatctaaactatgccaattcatgaacagatcatcttcttcatcaacgaaatcttaggttacggcctgcatgctggatcctccgcattcagtaatctttcccacagcatcggcttgttctaaaacagcacggtgcttagaccgtacataaaacacctgcatttctgtgcccatttgggcccggatgtgggtgtttttcattttcttccactctaaaattaagtatggaaaaccaaccgcacccggatgcacgacaatgacccactaaacacgtatccttgaatgcgtgactgaacattatgacgtagtagtactcggagccggccccggtggctatgtctccgccatccgtgcagcgcagcttggcaagaaggttgctgtaattgagaagcagtactggggtggtgtttgcctaaacgtgggctgcattccttccaagtctctgatcaaaaacgctgaagttgcccatacctttacccatgagaagaagaccttcggcatcaatggcgaagtgaccttcaactatgaggatgctcacaagcgttcccgtggcgtttccgacaagatcgttggaggcgttcattacttgatgaagaagaacaagatcatcgaaattcatggtcttggaaacttcaaggatgctaagactcttgaggtcaccgacggtaaggatgctggcaagaccatcacctttgatgactgcatcatcgcaaccggttcggtagtcaacaccctccgtggcgttgacttctcagagaacgttgtgtcttttgaagagcagattcttaaccctgttgcgccaaagaagatggtcattgttggtgcaggcgcaattggaatggaattcgcctacgttcttggtaactacggtgtagatgtaaccgtcatcgagttcatggatcgtgtgcttccaaatgaagatgctgaagtctccaaggttattgcaaaggcctacaagaagatgggcgttaagcttcttcctggccatgcaaccactgctgttcgggacaacggtgactttgtcgaggttgattaccagaagaagggctctgacaagacagagactcttactgttgatcgagtcatggtttccgttggtttccgtccacgcgttgagggatttggtcttgaaaacactggcgttaagctcaccgagcgtggcgcaatcgagatcgatgattacatgcgtaccaacgtcgatggcatttacgccatcggtgacgtgaccgccaagcttcagcttgctcacgtcgcagaagcacagggcattgttgccgcagagactattgctggtgcagaaactcagactcttggtgattacatgatgatgccacgtgcaaccttctgcaacccacaggtttcttcctttggttacaccgaagagcaggccaaggagaagtggccagatcgtgagatcaaggttgcttccttcccattctctgcaaacggtaaagcagttggcctggcagaaactgatggtttcgcaaagatcgttgctgatgcagaattcggtgagctgctcggtgcacacctggttggagcaaatgcatcagagctcatcaatgaattggtgcttgctcagaactgggatctcaccactgaagagatctctcgtagcgtccatattcacccaacgctatctgaggcagttaaggaagctgcacacggtatctctggacacatgatcaacttctagaatccacctcgttggccctgtttctgtatggaaacagggccaaaaccgattttcaatccaaaccgagtgctggttagtgctcatactcacacaaacttttcgattatcaaagagaattatttctaaaattcggtatcgtctaagaaatgagtttgccaatagctcagcatcaaaatgctgtaaaaactgtcgtggtaccagctgcaggaatgggaacacggttccttcctgcaacgaagacaattccaaaggagcttcttcctgtagttgataccccgggtattgaacttgttgccaaagaggctgctgatcttggtgcaactcggttagcaattatcactgctccgaacaaagacggaattcttaaacacttcgaggagttccctgagcttgaggcaactcttgaggctcgcggtaagactgatcaactgaataaagttcgagcagctcgagaattgattgcaacagttccagtggttcaagaaaagccattggggcttggtcacgctgttggccttgctgagtctgtgctcgatgatgatgaagatgttgtggctgtcatgctgccagacgatttggtgctgccatttggtgtgaccgagagaatggcagaagttcgcgctaagtttggcggatctgttcttgcagcaattgaggtggctgaagatgaagtctcaaattacggagtatttaagctcggtgaactcgatgcagagtccgaaagtgaaggcattaggcgtgttgtaggaatggttgaaaagcctgcgcctgaagatgcaccatcaaggtttgccgcaacgggccgttatctacttgatcgagctatttttgatgcactgcgtcgaattgagcctggtgctggtggagaactgcaattaacagatgccatcgcattattgatcgaagaaggccatccggtacacattgtggttcatgaaggaaagcgccatgaccttggtaatccagctgggtacattcctgctgttgtgtacttcggacttcgtcatgcagagtacggttccaagattcaccgtgcggtgaaggaaatactcgctgagtttgaatcttaaaaaggaaaccgccttccacattgtgggaggcggttttctcatgcgattagaatcttatgccatggctaagaaagtagacacctcgaacgctacccccgctctagcccttcttacggagaggcagattccttttgagctggatgttcatgatgtagatccaaaatcatcaaagggctttgcattggatgcctctgaagtaatgggtgtggagccggaagtggtgtttaaaacgctcatggcagatattgatggtgaacacgtggtcgcgattgttccagccagcagaacgttgaatctcaagcagttggctaaggctggaaaaggtaagcatgcaaacatgatggatcgcagccgtgcacaggtagttacggggtatgtccctggtggaatctcaccgatagggcagaagaacaagcaccgcgtgtttttggatgagtctgcaattctccaggagcgaatctacgtcagcgcagggcgacgcgggtggtccctgattatcgccccggatgatgttcttctggctaccgatggtgtttacgcggatattgctgatcattcataaaaggtaaaacccacccccgcaggggtgcgtcgtaaagcaagctccttttcttagtacggcgcgatagtggattcgtgcgcgtcgatgttgatgcggccgtggacggatgggaatgcgcgctgcgcgcagttctcgcgggtgcacactcggcagccggacccgatgggggtggcggtggagaggtcctggaggttgaaaccgcgggagtacacagtgcggtcggcgtggcgcgcttcgcagcccaggccgatggcgaacattttgtctacttcgccgaaccgggcttcgtggtgtcgcacggtgcgtgagatccacaggtagttgcgtccgtcgggcatttgcgcgaattggcggagcacttggccggggttggtgaaggtttcaaacacgttccacagggggcaggtgccgccgtagtgggtgaagtggaagccggtggcggattggcgtttggacatgttgccggcgcggtcgacgcgcacgaaggtaaaggggatgccgcgcaggttggggcgctgcagggtggacaagcggtgggcggttgtctcatagcccacgccaaagagttggcctaggtactcgatgtcgtagccggatttttcggcctcggagtggaagattttgtagggcagcatcacggcggcggcgaagtaggaggccacaccgcggatggctagggtgcgggcttcgggggtggaccagatgccgtcgtcaacgataccttcgatgaggtcgttggcttctaggtagccgagttcggtggccatgcggaaggcgcgttgcccggggttgaggcgtgcgtggattgtcagcagacgcgtctcggggtcgaagtggtgcagcgtgccggattcctctttggaggaggtgatggtgacatcgtgatccatttgcaggcggcgggcgatcgaatcttccatggcgcgggaatcgtacggctgccagcccagttgcgcggcgatggcttcggcgcggcggtcaagggcatcgaagtagttttggcgggcgtaaatgaaatcgcggacctcttcgtgcggcatgctcacggcctccgcgatgggacggcgttcctcaggcgtgttggtgcgattatccactgcgatggagaacttatcgcgcacgtttcggtaacgctggtgcatttccaccatcgcgcgcgctagttgggggtggttgtacaccatctccgaaagctcttgcagctccacgttcgcaggattgatctcccggtccagcatgacgtcttggacctcggcgagcaggcgggagtcatcgtcgcgggagaaaaacgttgcgtctacgccgaacgcctcggtgatgcgcaataacaccggtacggtgagcgggcgtacgtcgtgctcaatctgatttacataacttgcagataagccaagggttgctgctaaggatgcctggctcaggtctctttcgcggcgcagttggcgcagcctggaccccacatatgtctttcccatggcgcaactatagcgtgatcaccatcaccttaaccactcttggcactgaggtgttgcaaacttgttgattttcgcttttcgacgcagcccgccgccaccaggtgcccggcgtggtcgggccacatccgccccgggaactttttaggcacctacggtgcaactgttgggataattgtgtcacctgcgcaaagttgctccctggatcggaaggttgggctgtctaaactttttggttgataccaaacggggttagaaactgttcggatcggtatcctgtgaggaagctcaccttggttttagaatgttgaaaaggcctcacgtttccgcaggtagagcacactcaattaaatgagcgtcaaacgacaataaagtaaggctatcctaataagtggggttttatgtctctaaacagccagttgggggtcatgggggagcgccccgtgactggttaatgccccgatctgggacgtacagtaacaacgacactggaggtgccatgactgttagaaatcccgaccgtgaggcaatccgtcacggaaaaattacgacggaggcgctgcgtgagcgtcccgcatacccgacctgggcaatgaagctgaccatggccatcactggcctaatgtttggtggcttcgttcttgttcacatgatcggaaacctgaaaatcttcatgccggactacgcagccgattctgcgcatccgggtgaagcacaagtagatgtctacggcgagttcctgcgtgagatcggatccccgatcctcccacacggctcagtcctctggatcctacgtattatcctgctggtcgcattggttctgcacatctactgtgcattcgcattgaccggccgttctcaccagtcccgcggaaagttccgccgtaccaacctcgttggcggcttcaactccttcgcgacccgctccatgctggtgaccggaatcgttctccttgcgttcattatcttccacatcctcgacctgaccatgggtgttgctccagcagccccaacctcattcgagcacggcgaagtatacgcaaacatggtggcttcctttagccgctggcctgtagcaatttggtacatcattgccaacctggtcctgttcgtccacctgtcacacggcatctggcttgcagtctctgacctgggaatcaccggacgccgctggagggcaatcctcctcgcagttgcgtacatcgttcctgcactggtcctgatcggcaacatcaccattccgttcgccatcgctgttggctggattgcgtaaaggttaggaagaatttatgagcactcactctgaaaccacccgcccagagttcatccacccagtctcagtcctcccagaggtctcagctggtacggtccttgacgctgcagagccagcaggcgttcccaccaaagatatgtgggaataccaaaaagaccacatgaacctggtctccccactgaaccgacgcaagttccgtgtcctcgtcgttggcaccggcctgtccggtggtgctgcagcagcagccctcggcgaactcggatacgacgtcaaggcgttcacctaccacgacgcacctcgccgtgcgcactccattgctgcacagggtggcgttaactccgcccgcggcaagaaggtagacaacgacggcgcataccgccacgtcaaggacaccgtcaagggcggcgactaccgtggtcgcgagtccgactgctggcgtctcgccgtcgagtccgtccgcgtcatcgaccacatgaacgccatcggtgcaccattcgcccgcgaatacggtggcgccttggcaacccgttccttcggtggtgtgcaggtctcccgtacctactacacccgtggacaaaccggacagcagctgcagctctccaccgcatccgcactacagcgccagatccacctcggctccgtagaaatcttcacccataacgaaatggttgacgtcattgtcaccgaacgtaacggtgaaaagcgctgcgaaggcctgatcatgcgcaacctgatcaccggcgagctcaccgcacacaccggccatgccgttatcctggcaaccggtggctacggcaacgtgtaccacatgtccaccctggccaagaactccaacgcctcggccatcatgcgtgcatacgaagccggcgcatacttcgcgtccccatcgttcatccagttccacccaaccggcctgcctgtgaactccacctggcagtccaagaccattctgatgtccgagtcgctgcgtaacgacggccgcatctggtcccctaaggaaccgaacgataaccgcgatccaaacaccatccctgaggatgagcgcgactacttcctggagcgccgctacccagcattcggtaacctcgtcccacgtgacgttgcttcccgtgcgatctcccagcagatcaatgctggtctcggtgttggacctctgaacaacgctgcatacctggacttccgcgacgccaccgagcgcctcggacaggacaccatccgcgagcgttactccaacctcttcaccatgtacgaagaggcaattggcgaggacccatactccagcccaatgcgtattgcaccgacctgccacttcaccatgggtggcctctggactgacttcaacgaaatgacgtcactcccaggtctgttctgcgcaggcgaagcatcctggacctaccacggtgcaaaccgtctgggcgcaaactccctgctctccgcttccgtcgatggctggttcaccctgccattcaccatccctaactacctcggcccattgcttggctccgagcgtctgtcagaggatgcaccagaagcacaggcagcgattgcgcgtgcacaggctcgcattgaccgcctcatgggcaaccgcccagagtgggtcggtgacaacgttcacggacctgagtactaccaccgccagcttggcgatatcctgtacttctcctgtggcgtttcccgaaacgtagaagacctccaggatggcatcaacaagatccgtgccctccgcgatgacttctggaagaacatgcgcatcaccggcagcaccgatgagatgaaccaggttctcgaatacgcagcacgcgtagccgactacatcgacctcggcgaactcatgtgtgtcgacgccctcgaccgcgacgagtcctgtggcgctcacttccgcgacgaccacctctccgaagatggcgaagcagaacgtgacgacgaaaactggtgcttcgtctccgcatgggaaccaggcgagaacggaaccttcgtccgccacgcagaaccactgttcttcgaatccgtcccactgcagacaaggaactacaagtaatgaaacttacacttgagatctggcgtcaagcaggcccaactgcggaaggcaagttcgaaaccgtccaggttgacgacgccgtcgcgcagatgtccatcctggagctgcttgaccacgtaaacaacaagttcatcgaagaaggcaaagaaccattcgcgttcgcctctgactgccgcgaaggcatttgtggtacctgtggtctcctcgtgaacggtcgccctcacggcgccgaccagaacaagcctgcctgtgcgcagcgcctggtcagctacaaggaaggcgacaccctcaagatcgaaccactgcgttccgccgcatacccagtgatcaaggacatggtcgtcgaccgctccgcactggaccgtgtcatggaacagggtggctacgtgaccatcaacgcaggtaccgcacctgacgctgataccctccacgtcaaccacgaaaccgcagaactcgcacttgaccacgcagcctgcatcggctgtggcgcatgtgttgctgcctgccctaacggcgcagcacacctgttcaccggcgcaaagcttgttcacctctccctcctcccactgggtaaggaagagcgcggactgcgtgcacgtaagatggttgatgaaatggaaaccaacttcggacactgctccctctacggcgagtgcgcagatgtctgccccgcaggcatcccactgaccgctgtggcagctgtcaccaaggaacgtgcgcgtgcagctttccgaggcaaagacgactagtctttaatccaagtaagtaccggttcagacagttaaaccagaaagacgagtgaacaccatgtcctccgcgaaaaagaaacccgcaccggagcgtatgcactacatcaagggctatgtacctgtggcgtatagctctccacactcatccctcgagcgcagcgcaacctggttgggcatgggattcctcctcactgctctggcaggcgttggcgcagtcctcttcgcagtcggcgcaaacagcgttggccagcagcaggaacactgggtcctctacagcatcatcggtgttgtattcgccgttgtctgcacagttttgggcaccgtcctgatcatcaagggccgagcaccttacaaccgttacgtcaaggaaaccggccgtacgcagtagtttctgtatgcaggttctttgactagcacctccaacaacaccctttcttccatttatgtgggggagagggtgttgttttgtttttgcttggagttccctggagccttcatcgacagcccccaagccctcgaaaacgccgaaagcaacccactgtggagccaactccccgcagtcaaaaacggtcaactctgtaccacggaaaacctcaccccatggatcctcaccggaccagcagcagctgagattgtgacctctgacctcgaggcatgtttcgctgcttaggagacatggaagattggtggaaattgggtcgtgcagaaggatgcttggagatataggatacgcaagttcgaattctcggcggagtagttcgtgcaaacttgtcattttaaattttttcctgaggaggcgacagggatgtctttcgagtttgaatccccaatttatgggtttcgccggaggttggcgtcgataagcaaaaatctttgcccgtatttggttgccaaacgtgcgtgctaggtaattgcagcttcacttgtatcactcagggtgatacaagtgaagattttgctgggctaaaccggcagtgcctcaccctgaactactttgaagggtttgaacacaccgtttttgccgggaccgatgctgaaaaggtgctcgggatccatgacgtggctgcggtcggtgtaggaaagtaggtattcatcaaaggcggggagggttagttccaacgctagtgcatcagaaacctctgcgtctgtgacatcatctgcccaggtagggatccacatttcttcaccattcgggccttcaacagagtgaatcagtccatccgaagacacggcagcgatgcctttctttacatcacgcacagtcagtccggtccaccacaccagatctttcacagtggcagcaccacgggagtggaagtagcgacgggtcatctctgtgagcgcttcgtcgccgttaagtgctagggaaagggggcagatggaatcgagaagcacaaaggaatcttccgttccgatgggcgggccttgtacgatgtcaccttcgccaccgaaatgccggagtaaatgttggcctctgtgctcgccggggtcaacgtctacggatcggaaaatttcgtaggcctgggttctggatacgggggatttttcggcggcggttgttagtgcgtcgcgggcgcgctggactgcggcgctatcaagcgaaaggctggagcggcgcttggctgaagcagccaggatgcgtggggagcatagtagcgtcatccagcggacgtcttcggcggcaagtatttggtgggtgccgcgctgcgtccagctgcggatgagcagtgactttcttaatgccgtggcggcgtcggcgttttccgagcgggtgtctagcgcaacgagtgcggaaccgcgttgttgggcctggctggcgagcatgtgttttgccacgtcgacggcattgcgctcggacttaaaattcaacgccgcagatggtgcaagcagctgtgaaatgaggcgtagggcgcggacgcgttccagagaaagtgcaggcataacccctaaaataccctgatcttcccccgtgtcctgcccccgtgtccacccctgcgtacataataggacgcatgggaaaacatgaggttgctcagcagacggttccgggtccttcgccggaaatggaagcgcagcggcgtaaagagttgcgcaagcacaaggccattgccactggcctgttgatttttgctgccgctgtatattttctttgccgtttcgtggagacccgtccgggtgaaactgcagcgtgggtaggttttgtgcgcgctgcggcagaggccggaatgattggcgggttggccgactggttcgcggtcaccgcgctgttccgtcatccattgtggctgcctattccgcacactgcgattatcccgcgcaagaaagaccagttaggtgaggccttaagcgggtttgtgggggataacttcctaaatgcccagctcattacggaaaaagtctctcaggcgcggatcccagagcgcgccggggagtggctcgcccagccggaaaacggggagaaagtttcgcgcgaagtcggcaaattgaccgctaatattgtgcgcgcaatcgatccgtcagatgctgaagcggtgattaaatctgcggtgatcgacaagcttgcggaacccacctggggcccaccagctgggcggttgctggaacaactcctcgccgaaggcaaagccgaaccagttgtccaggaactcgcgcagtggctgcacaaaaaggcgttgggctccgagccgctgattgatcgcctgctcaacgagcgccgcccgatttgggcgccgaaattcactgcgcagctggtcagcggcaaagtctatgacgaggtcataaaattcactgaagccgtcgctgccgatcctaaccacgaggcccgcaaatcgctgcgccgattccttaataaattggcgcaagacctgcagcatgacccaggcatgattattaaagttgaagaaatcaaacgcgacatcatgggctccggcgccatcgcgcaagccgcgccaaccatctgggcgtcagcctccgagtcgctcattgaatccgcagaagatgagtcatcaattctgcgtcgcaaaattgccgaagcagctaccagctggggtcaaagattgcttgtcgacgactccctccggcattcactcgacacccggattaccggcgccgctgctttcctcgccgacaattacgcccccgaagtcaccggcattatctccgaaaccattgaacgatgggacgctgaagaagcttcagagaaaatcgaactcatggtgggcaaagacctccaatacatccgccttaatggcacaattgtaggtgcattagcaggactggccatttacgctatttcccatatcctcttcggagcttaactaggagtaaccatcatgtccgatgcaaaagacgattccatcttgtccaagtggagcaatgcagcttccgagctcagcggtgccgtcagtggagtagcgaagaagctccgtgaagaactctctgagaaggaaaccttcagcaagcttaaaaccgaagccagcgaagccgtcgatcaagcaaagtccggctcctacctagatgccggtaaggaattcgcccgcgacgccggatccatcatcaaagatgcagccaaaaccgtcaaaggtgccgtcagtgattccgataaaaacgacgtgaaatccgccttcggtaacgccgtggaagcttcccgcgacaagttcgatgacaccctcgaaaagcgcaaggctaagaaggattccccagaaccaggcgatgacgatatcatcgatggagaagtaattcctccgcagaattaaggaagtcggtttcaccccatggatatttccatgctcaacgtaataacgagctacaccatttgggccatttttgccatcatcggcatctgcggattcgttggtgccttcttggcagccaccaccagagaagatgcctttgaggttgctgatcgccaaaagaaaatggtgtgggtagcaatccttatcgcatccggatttgtcctcaccgcgctaggtccatcgattccgatcctgccatgggtcgccatcatcatgatcggcctgtactggtttgatgttcgcccgcaaatcaagagcatccttgaaggtgccggcggctggtaaaagctccctgaactgcgaaaattcccctacatcccgtaggggaattttttcggcccatgtgcggttgtgtcctaagtcattgatgtcacctaacgcccctaagttcactcggtgcaatattgcactgagtgcaagtttacactaggtttacttcagtggatattgaagagcagccctcgttaagagaaatcaagcgccaaatgaccctggaagcgatagaagataacgcaaccaggctcattctggagcgtggcttcgacaatgtcacaatcgaagacatctgcgcagaggcagggatatccaagcgcacattctttaactacgtggagtccaaagagtctgtggccatcgggcacacagccaagctcccaacggatgaagaacgtgaagcattcctggctacgcgtcatgaaaatattatcgatactgtatttgacctggtaatcaacctctttggcaaccacgacaactccaagtctggagttgcaggcgacattatgcgtcgacgcaaagagatccgggtgaagcatccagaactggcagtgcaacatttcgccaggttccaccaagcacgcgaagggctagaacacctaattgttgagtacttcgaaaaatggccaggctcccaacatctagatgagcctgcagatcgagaagcaatcgccatagttggcctgctgatctcggtcatgcttcaaggttctcgtgaatggcacgacatgccacaaggcacgcaagctgatttccaagcctgctgtcgcaaagcaattaaaaatacttttcttcttagaggtggattttcagaatgacatcacaggtcaagccggacgacgaacgtccggtaacaacaatttcaaaaagtggtgcaccttcggcccacacctcagcaccatatggtgcagcagcaactgaagaagctgtcgaggaaaaaaccaaaggtcgcgttggatttatcatcgcagccctcatgttggcgatgcttcttagctccttgggtcagaccattttcggttctgccctgccaacgattgttggtgagcttggcggcgttaaccacatgacctgggtgattaccgccttcctcttgggccagaccatttcattgcctattttcggcaagttgggtgaccagtttggtcgcaaatacctcttcatgtttgccatcgcactgttcgtggtgggttccatcatcggtgctttggctcagaacatgaccaccttgattgtggctcgtgcactgcagggtatcgccggtggtggcttgatgattctttctcaggcaattaccgctgatgtcaccaccgcccgtgagcgtgcaaagtacatgggcatcatgggttccgttttcggactgtcctccatccttggcccattgcttggtggctggttcactgacggtccaggctggcgttggggtctgtggttgaacgttccaatcggcatcatcgcactggttgctatcgctgtgctgctgaaacttccagctcgtgaacgtggcaaggtctccgttgactggttgggaagcatcttcatggctatcgccaccaccgcatttgtcctcgcagtgacctggggtggcaatgaatatgagtgggcatcaccaatgatcatcggtttgttcatcacgacattggtcgctgcgatagtgttcgttttcgtcgaaaagcgtgctgttgacccactggtccccatgggccttttctcgaaccgcaacttcgtgctcaccgccgtcgccggtatcggcgtaggcctgtttatgatgggcaccatcgcgtacatgcctacctacctgcagatggttcatggtctgaacccaacgcaagctggtctgatgctgatcccaatgatgatcggcctgattggtacatccactgtggtgggcaacatcgtgtccaagactggcaagtacaagtggtacccattcatcggcatgctcatcatggtccttgccctagtactgctatcgacgctgacaccttcggcaagcttggctctcattggactgtacttcttcgtcttcggattcggcctgggctgtgcaatgcagattttggttctcatcgtgcagaactccttcccaatcaccatggttggcaccgcgaccggttccaacaacttcttccgccaaatcggtggagcagtaggttccgcactgatcggtggcctgtttatctccaacctgtccgaccgattcaccgaaaacgtccccgcagcagtggcttccatgggtgaagaaggcgcacaatacgcctcagcaatgtccgatttctccggtgcatccaacctcactccacaccttgttgaatcacttccacaagcactccgtgaagcaattcaactttcttacaacgacgccctgacaccaatcttcttggcgctcaccccgatcgcagtagtcgccgcgatcctcctctttttcatccgtgaagatcacctcaaggaaacgcacgaataatgacacacgaaacttccgtccccggacctgccgacgcgcaggtcgcaggagatacgaagctgcgcaaaggccgcgcgaagaaggaaaaaactccttcatcaatgacgcctgaacaacaaaagaaagtctggtgggtcctcagcgcgctgatggtcgccatgatgatggcctcccttgaccagatgattttcggcacagccctgccaacaatcgtcggtgaactcggcggcgttgaccacatgatgtgggtcatcaccgcatacctacttgccgaaaccatcatgctgccgatctacggaaagctcggcgacctggttggacgtaaaggtctcttcatcggagccctcggcatcttcctgatcggctccgtcatcggcgggcttgcaggaaatatgacctggttgatcgtcggccgtgccgtacagggcatcggtggcggtggactgatgatcctctcgcaggcaatcatcgcggacgttgttccagcacgtgaacgtggccgctacatgggtgtcatgggtggagtcttcggactctctgcagttcttggcccactactcggtggctggttcaccgaaggaccaggctggcgctgggcattctggatgaacatcccactgggaatcatcgccatcggtgtcgccatttacttcctggacattccaaagaagagcgtcaagttccgctgggattacctgggcactttcttcatgatcgttgccgcaaccagcctgatcctgttcaccacctggggtggatcccagtacgagtggtctgatccaatcatcattggactgatcatcaccaccatcgttgccgctgcactgctggttgttgtggaactgcgcgcaaaagatccattggttccaatgtccttcttccaaaaccgcaacttcacgctcaccaccattgcaggcctgatcctgggtatcgcaatgttcggcatcatcggctaccttccgacctacctccagatggtccacggaatcaacgccaccgaagccggctacatgctgatcccaatgatggtcggcatgatgggtacctccatctggactggtatccgcatctccaacacaggaaagtacaaactcttcccaccaatcggcatggtggttaccttcgtggcactgatcttctttgcccgaatggaagtgtccaccaccctgtggcagatcggaatctacctcttcgtcctcggcgtcggcctgggtctagccatgcaggttctggtcctgatcgttcagaacaccctgccaaccgcggtggtcggatccgcaaccgctgtgaacaacttcttccgtcaaatcggttcctcactcggatccgcgctggtcggtggcatgttcgttggcaacttgggaaccctcatggaagaaagaatgccagcagccatggcacaactttcaccagaagaacaagccgccatggcagcccaaggcggactggactccaacgaattgacgccggcaatcgtcaatcaattgccaaccgcgctccacgatgcgttcgccggttcctacaacgacgcactcatcccagtgttctacgtgatgatgccactgatcggcatcgcgctgcttctcttgctgtttattaagcaagaaaaactacgcgaaaccaccacagactaaacacaaaacaaatgagacctaccctcgggtaggtctcatttgtttagggtcgcgtcgaaaagcaaaaagccttaatcaaagacaaccgtgcggttaccgtaaaccagcacccggtcctccaagtggaaacgcaaaccgcgagccagcacctgcttctccgcatcgcggcccaaacgctgcatctcagtcggcgtatccttatgcgtcacacgaataacatcctgctcaatgatcggaccatcatccagatccccagtcgcataatggcaggtcgcaccaatcaacttcacaccacggctatacgcctgatgatacgggcgcgcacccataaacgacggcaagaaactgtgatgaatattcaacacacgaccagcccacatctcacacaaatccggcggcaaaatctgcataaaacgagccaaaacaatcgcatccggatcataaccattcacaatctcagcgacctggtcaaacgccttccgcttaccaaccgcatccttaggaaacggcacatggaaaaacggaacattatggttctccgcaatataacgcaagttctcatggttacccacaaccgcaacaacttccatcggataatcattctcagccacacgacctaacaaatcgtgcaagcagtggccctccttagacaccaacaacacagccttcttcacctgcgcagtgtcagtgaaactccacttagccctcgggccgaactcctccgcaagcggagcgaactcctcccgcaactgctcaatcgtggtatcaatcgactcagcgcgaatcgcctgacgagtaaagaaccaattcgaatcaggatccgtgaaatatccagcctcagtaatccaacccccacgctcagctaggaacgacgacaacttcgccacaattccagtggagtcagggcagccaaaagtgagcacaaactgacgctcttcaggcgcagcgctcggacgattacgaacttcaggagaactcggggtcattcgttgcattctaccctggaaattttcccacactaagtcaggtctaagtagggtatggatatgacgatttcccgctccaccatggcccaaatccttgactacaccctcctcggaccagaagtaaccaactccgaactggccgcatttatagattccgcaattgagctgggagtcggcacgatctgtgtccccaacagcatggtcaacctaactgcaaaagcccaagaagctggaattcgagtggccaccgtcgcaggattcccgcacggcaaaacccccgcgttggtgaaagccgccgaagcgcgccttgccgtacagtccggagcttccgaagtagatgttgttttggatattgcggtagtgaaagagggagatgccaataggttgctgcaggaaattgtggcaatcagggaggctgttccatctcctgtggtgctgaaattcatcctcgaaacagctgttgtgagtgatgaagcaattgtgactgcagtgaatgcgttgattgctgctggtgctgacttcgctaaaacttccacgggattccacccagcgggaggggcaactgttgaggctgttcgggtgatggcttcggcttctcggggaagggttggaattaaggctgccggtggggtgaaaacttgggaagatgcggtggcgtttgttgaagcaggggctactcgcattggaacttctaatgcgggagccattttggagggtgcgccggagtagtttggcgttctaatcgggactgatgggtaattgagggcggttaagagggttcgaagttcgattcgggggtcgggcttcggggcaatgcaaaaatccaccacaacctgcaggaatgttgagatctgtggtggattttcccgctttagaggccttgggatgcaaaaatcagaccgattctgctgcgaggctgctcgttgtggtgagtagttgatcagggaactcacagactcctggggtggggtgaaaggggctgaaaaatagccttgcatgcaaaatatttgatgctttgtgtgccgttttaagagcttgaaggcgaggaactgacactagagctcatttggagaattgggcgccttaaacgggagggaaccgaatcggcggaatcacagtctaacttaagcatgaagccaattagatttgaagatgtccagcatgaaatgaatagaagacagttctctgcaaagtacacaagagtagtgggaacgttttggattaagaaggaatatgcggaaaatccggttgtggtggcagatgcgctattgcggagatttcccaacggtgtaatcaggggattcactgcactgattgtgagaggatactccctgttggatgaacctcgaacggcggaaattagcgtcccgaggggagcgagccatgtgactgtccttttgggaaaagtcgtgcgccacaaaatgccagaggtgcatgtggtgaaggggaggcgctgcgtgagtgttgcccaggcgctgttggatgagtttcccgcgatggttctggaacagcaggtggcattggtagaccatttggtgaggcagaatgaggatctgtacaagcagctgcagcaggtgaaagcgctaaaggaagtgatgcggctggtgaatccgatggcggagtcgaggccggaatcgatgctcagggtgaggcttcgtcgtgaggggatttgggggtttgagccgcagattccggtggagtgtgatggggtgacgaggtttgtggatttgggaaacccgaagcttcggatagcgctcgagtatcagggggctgtgcattttgaggatgcggagaagaggtcgcaggatagtcggcgggtgaatgagttgagggctgcggggtgggtggtgatagaagtaacctggcctgatcttgcggatcaggccaggtgggggaggttgcttactgagttaaggaagcagatcgggcgggcagaggaggaaaggaaaatgaggaggacaccgattccaatgccaccggatccgtttaggccttactgaagcgggcgatggcgtcggaaacttctttgagttttgcgtcgagttcgtcgccgccgaggtcagctgcttctttgacacagtgagcgaggtgatcgtcgaggaggccgaacgccacgtttttgagtgcggagttcactgcggagatctgcgtgaggatgtcgatgcagtattgttcctcgtcgatcatgcggtgaatgcctcgggtttggccttcgattcttttgaggcgtgcgaggtaacgctgcttttcttcgatgtaaccgtgggtgtggcattcgctgttggacattagttgctccttgctttgaatcctcgcagacgcaaggaattggagacgacgaaaactgaactgaaggccatcgcaatgccggcaagcattgggttgaggagtccgatcgccgctactgggattagtgcaacattgtaggcgaaagcccagaaaaggtttcccttgatggtgccgagggttttacgggacagtcggatggcgtcgactgcggatcggaggtcgttgttcatgagggtgatgtcggaggcttcgatggctacgtcggtgccggctcccatggcgagtccgaggtcagcttgggcaagagctgcggcatcgttgacgccgtcgccgaccatcgcaacgtttttgccttgtgcttggagggcttctacgttttggactttttcgtgggggaggacgttggcgatgacttggtcgatgccgacttcagcggctacggatttagctgcgccttcattgtctccggtgagtaggattggggtgagtcccagttccttgagtccgcggattgcttcggcggaggtgtctttgacggtgtcgcggaccgtgattattccggaatctacgccgtcaatcgtgacgactacgggggttccgccgattttttgggcgtgttggaaggggtggaggagggcgtcgataagcgtgcttgaaggcctgcccacgcggacctcgtgtccgcggactacaccggtgactccctgacctgcggtgttttggaagtcggtgacttgctcgtgttcggcggccttggcgattgcctgggcgatggggtgttcggaggcggactcgacggctgcagcgaattcgaggatttcggtttcgctgtagttgatggcggtgacgtcggtgacggacatggtgccggtggtgacggtgccggttttgtcgaggacgatggtgtcgacttttttggtggattcgaggatttcagggcccttgatcaacagaccgagttgcgcgccgcggccggttccgaccagaagtgcggttggggttgccaggccgagggcacaagggcaggcgataatgaggacggcgactgctgcggtgaatgctggggcgaggccggcgtcggtgaagacgaggtgcgcgatcagcgtcgcaatagcaattacgatgacaacgggaacgaaaacctgcgagatttggtcaacaagacgctggacaggggcctttttggactgtgcgtccgtgaccagtttagccatttgcgacagggtggtgtcggcgccgatgcgggttactttcaccatgaggcggccggaagtgttcagcgttgcgccggtaactttggagcccttggtgacttcaacggggatggattcgccggtgagcatggattcgtcgactgcggaggaaccttcgacgacttcaccgtcggtggcgattttctcgccggggcgggtgatgaaaacgtcgccgagtttaagctgattcacaggaacgcggacttcggcgccgtcacgtaagacgactgcatctttggcgcccatgtccagcagcttgcgcagagcttccgaagattggcccttagcttttgtctcaaaccagcgtccaagcagcaggaacgtaataacgaccgcgacggtttcgaggtaaatctcatccatcgtggaggccgacggcagcaggtgcatctccatcttcatgccagggtgaccagcatttccaatgaacaaagcccacagggaccacaggtaagcagcggacgtgccgagtgaaaccagggtgtccatggtgaaggaaccgtgcttcaggtttgcccacgttgccttgtggaacggtgaaccgccccagaagaaaatcggggtgaccaaagtgagtacggcccactgccagttgttgaattgcagcgccgggatcatgctgaccaaaaccacaggaactgacaacagtgcagagacgatcacgcggtgtttcaggtcggctgcttcgtggtcgcgagctgcgtcgatgcgggactggccgctgtcagctggagcgttgtcctcttctgattcggcagctgcggaagccatcgtgaaagcaccgtagccggtgtcctcaacagtcttaatcagctgttcagggctgacctttgaggggtcgtagctgacctgtgcggattccgtcgcgtagttgacggttgcttcaacgccgtcgagcttgttcagtttgcgctcgacgcgggcggagcaagaagtgcaggtcatgccggtaacgccgaggtcgacgtcaatgaaattcagtgccgccgggattttggcgggtgtctgagccatgggatcgctccttctgcgagtatgtttacatgactcactgtataccccctaggggtatgggtcaacccttcgcgggaacatgcctggcgtaaaccacgtgagggtcattgcaattactgccgcgataatcgagccccatgtggcgtcgacgaacctgtatatcgcgaaactaatcgccgcgatcaggaaccaaattagcggcacaaaaatggatgttcgattattgcgtgtgatttcctcatcaatccagccttcctgtggaaacctggcgcgcgcttctcgacgaatcctcctcgccgttttcgacgccggcacgaaggtggcaaacaagaccaaaacgagacccactcctgtaataagtaggtccccacttgccgcgccgaaagcgatggtacctgcagcaacacatgccgcaagacgttcaccgaaagtgatgggaatgggcgttaatggatctacgtccggatagagattggggaaagctgcattttgaaaagtcatgatggcgtctcgggctctgtgaaaggtcggggggaatcaaccttttggcgggttctgaaattgaaacaatttaagttagcatagccttaacttcatttgtgcgttgattactttgatgcaaacaaaatgatggcctgcccctgaaacttttacggctttcagagcgcagggcatcattttcttgtgtcgccaacacttgagaaaaattgcggaaaaggacactgctgttcatgaaacttgcacctcgtatgcggatgaggagccccaaaactttcgcggccctcgcctcacttgctttagtcataggtctcggccaggtaccgatcgcccaagctcaaaccgagtatcgaaccgcctccgacggttccctgaactggggatttaggcaatcgttccgcaattacatccaaaccggcgtggccaaaggttccatcacgcttggcgacggcgcatccgacaacggtggcaacttcgcattcaccccacgcaccaacggcaccaccgtgaccagcgattcccaaggcaccgtggaattcaacggctccgtgcacttcctcggacaccaggcagaggacaaatggatcctggacaccaccatgtctgacatcaaaatggtgttcaacggatcctccgcgcagctagttgtggatttggttgcccgcgaattcaagggcaccacctacgatgacatcggcgaatacatcatctccgacgacatcgtgcttgccgacgtctccctcaactccgccgccgacttctcccaagattccatcgacctgtccggcaccaccgacctcaccgcagctggcgcccaagctttcggaggattctacgaaaccggcgaagccctcgacccgaccggcggcagcctgaccatttcctccaccaccaccgcgccatcgaccagcacgacctccacctctgcctcaacttccggtggaaccgccgactgttcctccggcgcattgggtgttgtcaccaccggaaccaacgacggcatgctgggcaccatccaggaagtaaacaacaccttcgcgatttggaacaacctcatcgtcaacaccgagcgcatgttctgcaacattgataccctcaaggcgcgcttcgacacggatgattccagcgattcagcgacctctgcgacttctgggactactgcgtccaccggcaccaccgctgcaactaccgcgggaaccacgggtaccactggaactgccagcaccgcttccggaacttccggaacttccggaacctccggcaccgcagcaactgtcgctggcaccaccccaactgacaatggcgtttgcaccgcttccggatctttgggcgtgacccaagcatctgcgcagtggggtgtgaaggcgtccttccagaactacattcgcggatcgatcgccaacggtagctggactctcaacggcgttggttttgataatcagcagttccaattctctggaaattccggagcagtcgacgcggaaaacaagaccggcagcatcaatttccctggttccatccacttcacgggtcacggcggaatcttggacatgcagatcgcaaacattgagatcagcttcaacggcaactccggcgagctgattgcggatgtcgtttcctctgacatggatggaaattccaccaactacggtcgcactgtcgtgggcaccctgaacttctctgcgttgaatgtttctgcaacggaagcttccggttccgcttcggtgtccctgtcacagtcgggttcgcaggcgttcgctgatttctacaccccaggcacccagttggatccgatcagtttcagcgcaactttgggcggcgacgccagctgcgccaccggatccacctcgaccacaggcgctgctgccaccgcgaacactgacaacaccgaaggtgttgccggcgaggaatccaccacccccgctaaccaaaacagccagttccaaatccgccaggccgctgcagattccaccggactggataccaccaccacaatgttgctcatcctcgcggcgttcgttgtcgcaggtggctccatgactcgcttcaccgtcggcaacccgactggaaaataaggcttcacatgaataacgcttttcgacgcacccttacatccgtagtcctcgccgctagcttggccttaacggcctgcgcaagctgggattcacctacggcatcttccaatggtgatctgattgaggagatccaggcaagctccacctcaacagatccgcgcaccttcacaggcttgagcatcgtggaagatatcggcgatgtggttcccgtaaccgacaacgcctcaccagctctgccagtttctttgaccgacgctgatggcaacgacgtggtggtggaggacgtgtcccgcatcctcccactggatctctacggaacctattccaaaaccatcgctggcctgggactcgtggacaatattgtgggtcgtactgttagttccaccgagcctgcattggcggacactgaggtggtcaccactggcggacacaccctcaatgctgaagcgatccttaatttacatccgactttggtgatcatcgaccactcgatcggcccacgcgaagtcatcgatcagatccgcgcagctggtgtcgccacggtgatcatgtcgccgcagcgttccattgcctcaattggcgacgacatccgcgacatcgcctccgtcgttggacttcctgaagaaggggagaagctcgcggaacgttccgttgctgaagtcgaagaggccagcacggttgtcgatgaactcaccccagaagatcccctcaaaatggtattcctctatgcccgcggaactggtggagtgttcttcattttgggcgatgcctatggtggacgcgatctcattgaaggcctgggcggcgtcgacatggctgctgaaaagggcatcatggatctggcaccagccaacgcggaagcacttgccgaactaaatccagacgtcttcgtgatgatgtcggaaggactagtctcgacaggaggtatcgacggtcttatggaacgccccggcattgctcagacaaccgccggacaaaaccaacgagtactggcgcttcccgatggtcaatcattggcctttggtgcccaaactggcgagttgttgctccgcgcatcccgcgaactgtatgtgcagggcggcgagtagatggttgtgaaggaggttgacgtcgaaaagcaaaaagctggccgggtgcctggtgctatagctaagcgtcggaccgtgcggattgtgctgtttgtcgcgctgggcgcgatcgtgattgcggcgtcgctgtggtcgattctggtcggccaatacaccatcccgattcgcgatctacctgcgattttagcctccggtccgaccggtgcgcagacgatggcggaacaagtcgtgtggcaaatccgcatgccgcgcatcgtgctgggactgctcgtgggtgccgctttgggcgtggccggcgcgctgttgcaggcggtgttttccaacccgctggcggaaccgtcgatcatcggcgtgacctccggcgcgggcgtgggtgctgctgcggtgatcgtgtttaacctgacatttttgggcacatccaccgtcgcagtcggcgcgtttattaccgcggtgatcaccacgattttggtatatcagctggccagaagccgtggacgtgtgcaagtgatcaacctgatcctcacaggcatcgccattaatgcagtatccggcgcgctgacctcgttcttcatctacatcgcgccgacgagctcccgcgaagaaattattttctggcagatgggttccctcaacggctcgcaatgggcgcacgtcaacgtggtgtttgtgatcgtgacaatcggcctcgtcgccgcatttggcctgggcaaacagctcgatgtgctggcgctcggcgaaagcgccgccggacacgtcggcctcaacgtgaagaaactgcgcatcatcgcgatcgccgtatccaccctcctcactgccggtgccgtcgcatacgcgggactaatcagcttcgttggcctgatcatcccgcacctgcttcgcacagtcaccggacctgccaacaaaatcctcgtaccagcctccgcactgggcggcgcagcactgatcagcgtctctgacatcctcgccagaacgctcatcccatacgctgacctgccgatcggcattttcacagcgctggtcggcggcccaacattcttcataatgttgcgccgaatgatgaaaaagggcgtgcactaaatggccattgtttccctcgacaacgtcaccgtatccattgaaggaaaaaagcttctcgacgccgtctccctcaaggcctaccccggggaagtgttgggactcatcggcccaaacggtgccggaaaatccactctgctgagtgtcctttcaggcgatcggcttcccgattcaggcgaagtcaacgtcggtggcttagatcccgcaacagcagcggcatccgatatggccagggtgcgagcagtcatgcttcaagatgtcagcgtggcattttccttcctcgtgtgggacgtcgtagaaatgggcaggcggccgtggcagaaggcgtcaacccccgaagaggatcatgaaatcatcgaagcagcgcttgccgccacctcggtatcgcaccttgccgaacgtgaaatcaccacactgtcaggcggcgagcgggcacgcgttgccttgtcccgtgtccttgctcagcaaacccccattgtgctgttggacgaaccaacagccgcgatggatatcagccaccaagaacaaactctgggcacagcgcgagcactggcagccgccggggcagcagtgattgtggtccttcatgatctcaatgcggccgctgcatattgcgacagcattgtgtgtctcagtgatggtcgagtgattgcctccggttctgttgatcaggtgtattccacggaaacgctgtcccgtgtttacggttggcctatcagggtcgatcatagtggaaaatatgttcgagtggagccggaccgttctgaggcgaatttaccctccgtactacaggtgaaaaatacggtttcaccagcttagatacatgactaactaaggttaccctaccctctttggggtagggctcttccatttttgccaggttaggttaagctaatctagtttttattgcgttatcgaacaggagaacaaaaatgaacaagcttgccacccgtgcgctcgttgctctcacgggatccgccatcgccatgaccggcctcaccgtagtctcggctaatgcagccgagaaaaccggcaaatgccgcgttgtcaccaccacaggaaccgccgactggtcagtgcgtgaatcattcaacaactaccttgaaggtccaattgcaaacggtgcagcatacaaataccacggtggcatcgaggtccgtgacggtgtagaaaccaccggcacgaagtcagctcgcgagttcacctggccagtacttggcagcgaagaaggagccgtcaaacttggcggtggcgttcactggaccggacacaatcactactccggcgacgacgagtcccaggcgccagacaacttcatccttgatctcgacttctccaacccaaccgtcaaattcgatggcaacgagggcaccctgcttgtcgacttcaagtcccgtgagttcgttgataccaagaccgtcgctgacttcctcaccggaactcaggcagagttggctaccatcactttcgatgagccaatcgacctgacccaggagaacgtcaccgtcaccggccagaccaagctgactgcaactggtgtcgatgtcatgggcaccttctacccagaaggtgaagcacttgcgccaatcactttgaacctcaccaacgaagttgtatgcgacgagcctgaaacccccgttgagcctgaggttcctgtagagcctgagactccagtagatccggaaacctcggtcgacccagagactccagtagatccggaaacctcggtcgacccagaaaagcctggcgatgacaacaaggatgacggaagcaacagcagcagcaacggcgatatcctcggaatcttgggcatcctcgcagcgcttggtggcgttggtgcacttgtgtacaacttcctggtagctagcggattccttgcagcgtttaagtaaatgaatcgttttcctagtgccttattagcagcctctgtcgcgggggctgcgttggccattccagcgacctctgcacatgcagcagaatctatttgtacattcaccggcgatgttgggtggaatgtgcgcgattctttcaacagttatcttttgggaaacatcgcaaatggtagtgcttataaatataagggcgggttggacgttcgtgacggcgtccagaccgacggtaacggcaaaactccagcactgacctggccagttgattcggtgacgtcttcgaagatttccacttccggaggcgcgcactggaccggacacaacctgtaccccggtgatgacctcgcggaagtccctaacaatttcacgttggatcttgatttttccaacatcactgtggagctgagtggttctacaggtcggttgttggtggattacacatctcgggaatacatcaacacccacacgttgggtgagtttcaaactggtgaacaggctgagcttgccacgattacttttgccaaagctccagacctcacctctaattcagtcaacgtgactggcgatgtggcattgactgctgatggtgtggaagttttcggtggtttctacacggcaggggaggagttggcgccaatcacgctgaatctcactgcagatgagggatgtggatcgacccccgagccggaggacccagaaaccccttctgcatcgtcttctgatgtcagcagcagttccttcggggatacgattactcaggtgttgtcgattggttcgatggtgggcatggctggtttgttgttcacgatcgtgaattacttcatccaaagcttcgccccataaacccataaacccataaaccagaaaaaaatcgctgtcaccgtagaggtggcagcgattttcttcgtttaggactaaaagtcacagacgcgaaagcgctctttactgtgcggcttctagggtctggatgttgatgttgtctccggtcagggtgacgttgatgccagcgtcgacaacttcgaggctttggatttgcaggccaccggctacttcattgattgatgattgcagtgcgtcggtgagcatttgggagatttcatcggggaggccgaatccgaagagttgggaatctacgatctcaaagccgagttggccgttcgttacgatggggtgcagtgaggctcgggcggcgccgtcggtgaattcaacttcgatggtttgattagctgcatcggaagtaatgtcggtgactttgatgagttcctggataagctgttctgcgaatccttgggaggtgctgttcccgccggttgcttcggccatctgctgttggatggttgccaggatgaaatcgtcggttgccaatgtggttaaggtgaggtggtctgcgactgggttgtcgcggtcaccgatatcaagcccttggagttggatagttgactctggtgtgccactgatggaggggacaccgtcttggttagtgatggatacggagtcgggggtgtcgattgtgacttcattgatgcttccccgagcgatgcctaacaggagtggggatgcgccgaagctgatggagggctcttcagttgcagagattccttgtgaggaagcctgagcttggaactcatctttcagttgttttccgatcatgaagcgcagcccgaattctgctaccagcacgagcaggagcaggatcaccacgatggtgagcaggactttaggtaaagcagatttctttgatttagccacgcccactagtgttccttatccggctgaggttggaaagttgcaaaccaggttaatcacctaaaaggttcctgtcagcacgcgtaaaacaattaaggcgccaccgtttcccacggtacagtcagcaggctatcgcccacgcgtcgcctggacactgcgatgggccaaccttggtcgatgagcatctcgcgggctttttcccagcgcacgcgcggtccgtggggttcccagccggcgcagtagtcccaggctaaatcagcggctgctagcagtgcgtgaatcttttcaccaggaatgttgcggtggatgagcattttgggcagtcgttcggccacatcggagggggtggagattccccaaggatcccatgcaagggtgagttcttgtgggccgtctgagttaagtgtgatccaggtgcagcgtttgccgatttcatcgcaggtgccttcgaaaaacagtccgcctggggcaagtctggaggtgacggtttcccatgcggcttcgacttggtccacgtcgtattggcgcagcacgttgaaggcgcgcacgagttgtggggtgtagccggcaagttcgaatccgccgagttcaaaggacacgccgttttggggttcgaggactcgttcggggttgatttctaggccgatgacatccatgtcgggttggaggcggtggagccaacgtccccattcgacggtggttgtgtggctggcgccgtacccgacatctaacgccagggaagtggcgtcgagaagcgaacgtattttgggatgatgaaagcaccaccgatcgaagcgccgtaggcggttcacaccggtggtgccgcgggtgatcacgccgattggcttctgctttccgtttgcacccttgcggaaagaggcgcgcagattgtgggcgtgatcagccatttagaggttctcggagatccacttttcggtcagagcgccttcgtttgcgaagagctcgccgagtgcgtcggcaaccttaggctcgattgcagggcccatgaatgggatgttcacggacacttcgttgctgtagtcgaaggtggttgctgcgtcgtcgccgttgatggcgatggtgcccttgaaatcaacaggggtgcccttgacgtcagcgttgtactcgacggttgtggcgttgttggtcagtgcaggaaccgtgaggactcgcttgaccttcagtgcctggctgatcattgcgcgaactgcctctgggaggacctcgagtgggaggacctcaaaaagggttgcggttgcgccaccgtcagctgcggtgaactcgttgacctcgccagcttcgggggagaggttctctgcgatgtatgcccagtaggcttcggtggtcagtgcttggtgcaccttgccgacgggctgattgatcgtaatggtgttttctgtacgcgttgccatgaggataagactaccgttagtggggtgttggattcatcgctagcccaggaaatcgccgcgatcgacggcgtcgaactcgattcggaagtcactttcgccgatctgacgaccctccgcatcggcggaaaaccccgcagcgccgtacgttgccagaccacggaggcgctggtcagcgccataaaattgcttgacgacgcctccctccccctcctcatcgtcggcggcgggtccaatctcgtcgtggccgacggcgatctggatgttattgccgtcatcatcgaaaccgacgacgtctccatcaacctcaccgacggtctcctcaccgccgatgcaggcgctgtttgggacgatgttgtccacctttcggtggatgccggcctcggtggaattgaatgcctctccggaatccccggctccgccggcgccaccccagtccaaaacgtgggcgcctacggcacggaagtttccgatgtactcacccgcgtccagcttctcgaccgcaccacccaccaagtctcctgggtcgacgcctccgaactcgacctctcttaccgatactccaatctcaaattcaccaaccgcgcagtcgtcttggcgatcgaactccagctcctcaccgacggattgtccgcgccgctacgttttggtgaattgggacgtcgattagcgatctccgaggccgaaccccacccacgtcgccccgtccgcatggtccgcgacgccgtcctagaactccgccgcgccaaaggcatggtcgtggaacacaccgaccacgacacctggtccgccggatccttcttcaccaacccaatcgtcgacccagcccttgccgacgcagtctttgaaaaagtcggcgaacccaccatgccccgcttcccagccggcgatggcaaagaaaaactctccgcagcctggctcatcgaacgcgccggcttcaaaaagggacaccccggcgcaggcgcaaaagcctccctgagcaccaaacacaccctcgcactcaccaaccgtggcgacgcccgcgcctccgacctcgtcgcattagccaaagaaatccgcgacggagtcctcgaaaccttcggcgtcaccctcgtcccagaacccgtctggattggaatcagcatcgatgactgaattttccgacgtccctggcaccgccgccccactgcacagggcgttggaaaatgccggatactccactttagaatccctcgacggtgttccctacaagacgttgattgccctgcatggtgtcggaaaaactggcctcggcaggatccaggcagcattgttggaacgtggcctttccctgggggaagaaacaaaaggcgccaccatcaccccaggtcacaccggtaaagtggcctcagatatcaaaactcacatcacttccgtggatcccgtcgcatacgtcgatggtctagaggggcgtcgggttgctcacgggcaccaattgctatcgatcttcggtcgcgtcaccggcgcggaacccaaaatgtggggaccctccatgatcggatacggctcagtccactacgtttcccacaccggaagggaaggcgattggtttcagtgtggtttcagcccggcgaagtccaaaatctgcctgtatggcctgaaggattcgcctcgcggtgaggaattgctgcagaaacttggaaaatacaccgaaggccgcggatgcgtgtacatcaataaaccggaagacatcgatttggatgttttagaggccatgatcagcgagtcatgggccggccaaggctaggttgcaaatccccaccacaagttgctctgatcagcgattttgtggtggatttttgcgtctccgccacctgaaaccgcaaggattcaccacagattcgagttttcctttgaaacgtggtggatccttgccctgcaaactttcaggaatcacaccagtcccactggccacaaatgggaaacccctcagaatcgcttctgaggggttatctagcgccagttggggtaagtgcccatttgggaaactcgacctcttaaatcggcgtctacttgccgagcttcttcaacgtccactcgtgcggggcctgagttgcaaatccccaccacaaattgctctgattagtggatttgtggtggatttttgcgtcttcgctatctgaaaccgcgaggatccaccacagattcgagttttcctttgaaacgtggttgatccttgccctggaatctttcaggaatcacatcagtcccactggttacaaagtggaaacccctcagaatcgcttctggggggtgaactagcgccagttggggtaagtgcccatttgggaaactcgacctcttaaatcggcgtctacttgccgagcttcttcaacaactccgcctgcacttcacgacgcctaatcttgcccatctgatcccgcggcatctcctcaaagtggtagaaagtgcgcggaaccttgtagcgggtgaggttcttgcgggcgaattccttcaggccatccggatccagcgctgcaccttccaccaaagtgatggcagcaacgacgttttcggagccgtcttcacgcgggataccaacgactgcggaatcttcaatgtctgggtgctctgcgaggacttcttcaacctcagctgggtacacgttgaaaccgccagtgatgatgacttccttgatgcgagcaactaggcggatgaacccgtcttcttccatcactccgacgtcgccggtgcggtaccactcgccgtggaagctgttcttggtggcttcttcctggttgaggtaacccttgaacacctgtgggcccttgactaggacttcgccttcgctgccgtcgggcatggtttcgtcgaggttttctgggtttgcgatgcgcacgatggtgtcggggaaggggattcctacgtagccttggcgtcggtgatcgctcatggggttacccacgatgatgggggaggtttcggtgaggccgtagccttcgacgaggcgtccgccggtgtgcttttcccagcgttcaacggtgcgctgggagagtgtggatgcaccggagaaggcgttgcggactcccttgatggggattccttctttttcggaggcgtcgacgattttttcgtaaagggtgggcacgcctggtagccaggttggggtgtgctttttcattacgttcatgatcaggtcgatgcgtggggtgggaagtagcaccatttcgccaccgatgaacacggacagtgtgccgaccatggtcagaccgtatgcgtggaacattggtagggctgcaagcatgcgttctggtttgtctccgagacctggaacccagtgctttccttggaggagattggagaacaggtttccgtgggtgagctgggcacccttggggcgtccggtggtgccggaggtgtagaggatcagcgcgacggattctttggtcacggtgggttctgaaactacgtcgtcgccgtcgccgcccattgctgcgctggtcagggtttcaaaaggaacggtgttgggggctgcgccggagagggattcgcggctcttgcgcagtgcagggattgggagccgaagtgctaggcgctggagtggtggcatcgcgttgatcatgttgaccgacacgatggtttccaactgggtctgtccacgtagctgttcgacggtgggggaggctttgtcccagacgatggcaacgcgggcaccgtggtctttgaagggttcgagcagttcgtgggcggtgtagagcgggttgtgctcaatgactactgcgccgagtttcagcactgcgtagaaagctgcgatgtgctgtgggcagttggggaggataatcgctacgtgatcgccggggcggacacctagtgcgcgcaggccagcggcagttttgcggacttctttgtccagttcaccgtaggtttgtgaacgaccgaaaaagtaggtggctggcttgtctgcgttgatggccaggttgttgtcgtaaacgtccagcagggtggtgtcgccatattccagcgagtgtggcgtccactctgggtagtgctggagccattctttggtttcgtatgctgacatggtgtcccttcaactgcgttgctttagtgccctttagtatatagagacgtcccgctgctttcttcggcgatctagaatgtgggcatgcgcgtagctatgatttccatgcacacctctccattgcagcagcccggaactggtgattcaggcggcatgaacgtctacattctttcgaccgcgactgagctagcgaaacagggtatcgaggtcgatatttacactcgtgccacgaggccttctcagggtgagatcgtgagagtagctgagaatttgcgggtcattaatatcgctgcggggccgtatgaggggctttccaaagaggagcttcctactcagttggcggcgtttaccggcggaatgttgtcgtttacgcgccgggagaaggttacttatgatctgatccattctcactattggctgtctggtcaggtggggtggttgctgcgcgatttgtggcggattccccttattcatacggcacacactttggcggcggtgaagaattcttatcgggatgattcggacactccggagtcggaggcgcgtcgcatttgtgagcagcagctggtggataacgctgacgtgttggcggtgaacactcaggaggagatgcaggatttgatgcatcactacgatgcggatccggatcggatttctgtggtgtcaccgggtgcggacgtggaactttatagccctggaaatgatcgcgcgacggaacgttcccgtcgtgagctgggcattccgctgcacacaaaggtagtggcttttgtgggtcggttgcagccgtttaagggcccgcaggtgctgatcaaggcggttgcggcgttgtttgatcgcgatccggaccgaaatctgcgcgtcattatttgtggcggcccttctggtccgaatgcgacaccggatacctataggcatatggcagaggaactgggcgtcgaaaagcgaattcgctttttggacccgcgcccgccgagcgagctagtggccgtgtatcgggcggcggacatcgtggccgtgccaagttttaatgagtccttcggactcgtcgccatggaggcgcaagccagcggcacaccggtcattgcggcccgggttggcggcctgcccatcgcagtcgcggaaggggagacgggattgcttgtcgacggccactccccgcatgcctgggccgacgccttagccacactcttggacgatgacgaaacgcgcatcagaatgggtgaagacgccgtcgaacacgccagaacattctcctgggcggccaccgccgcacagctatcgtcgctgtacaacgacgctattgccaacgaaaatgtcgacggtgaaacgcatcacggctaagtaaacgcgcgtcgtggaacataaagtggcaaactagtacctatgactaacggaaaattgattcttcttcgtcacggtcagagcgaatggaacgcatccaaccagttcactggatgggtcgacgtcaatctgaccgaacagggtgaggctgaggccaagcgcggaggcgaactcctcgtcgaggcaggcgtcctcccaggcgttgtatacacctccttgctgcgtcgcgcgatccgcactgcaaacatcgcactgaacgctgcagaccgccactggatcccagtgatccgcgactggcgcctcaacgagcgtcactacggcgcactgcagggccttgacaaggctgcaaccaaggaaaaatacggcgacgaccagttcatggaatggcgccgctcctacgacaccccaccaccagagctcgcggatgacgcagagtactcccaggcaaatgaccctcgttacgcggacctcgacgtagttccacgcaccgaatgcctcaaggacgttgtggttcgttttgttccttacttcgaggaagaaatcctgccacgcgcaaagaagggcgaaaccgtcctcatcgcagcacacggcaactccctgcgtgcgctggttaagcaccttgacggcatctccgatgctgatatcgcagagctcaacatcccaaccggcatcccactggtctacgaaatcgccgaagacggttccgtagtaaacccaggcggcacctacctcgatcctgaggcagcagcagccggcgcagcagcagtagcaaaccagggtaataagtagctatttgtaggtgagcactcttcttgctttcgtattgggcgtggtcctcatgggcctcgccctacctgcgtatacgaaaattaaagatcggatgcgtcgccacaagtccgcggtcaccctgtccgaaaaccaggtcaccacggtggggcaggtcctccacctggcgattcaaggctccccaacgggaatcacggttgtcgatcgcaccggcgacgtcatcttatccaacggccgcgcccacgaattgggcatcgtccacgaaagatccgtcgacggcaacgtttggcgcgtcgcccaggaagccttccaagaccaagaaacccactcactcgacgtccacccagaccgcaatccgcggcgcccgggtagtcgcatcaccgcagtgcaggcagtggtcaagcctttaacgcttatcgacgatcgtttcgtgatcatctatgcctccgacgaatccgaaaacgtgcgcatggaatcggcacgccgagacttcgtcgcaaacgtctcccacgaactgaaaacccccgtcggcggcatggcactcctcgcggaagccctcatggaatcctccgacgacccagaacaagtcgaatacttcggatccaggctccaccgcgaagcccaccgcatggccgacatgatcaacgaactgatctccctttccaaacttcagggcgccgaacgactccctgatatggaacccgtccaggctgacgacatcatcagcgaagccatcgaacgcacccaactcgccgccgacaacgccaacatcgaaatcattcgcggcgaccgcaccggcgtttgggtagaagccgatcgatccctgctggtcacagccctggcgaacctgatcagcaatgcaatcaactactcaccaaaatcagtccccgtctccgtttcacaaagcatccgaaacgacgtggtcatgatccgagtaaccgaccgtggcattggcatcgcacccgaagaccaaggccgagttttcgaaagattcttccgcgtcgacaaagcccgctcccgccaaaccggcggaactggccttggcctcgcgatagtcaaacatgtcatggctaaccatggcggtagtattagtttgtggtcacgtcctggaacaggctccacatttacacttgaactccctgtataccacccagagtccaaggaaccggcaggatctaagcagggacctagtttggattcacctattcgtacgactgcgtccaaagcatctgggcgccgaaaggaaaaatcatgacgagaatcctgatcgttgaagatgaggaatcgttagcagatcctttggcctttcttcttcgcaaagaaggttttgacaccatcatcgccggtgatggcccaaccgcacttgtggagttcagtcgcaacgaaatcgacatcgtcctcttagacctcatgctcccaggcatgtctggcaccgacgtatgcaaagaactccgcagcgtatccactgttcccgtcatcatggtcaccgcccgcgactccgagatcgacaaagttgttggcctcgaactcggcgccgatgattatgtaaccaagccatattcttcccgcgaactcatcgcccgcatccgcgctgtcctgcgccgacgcggagttactgaaaccgaagccgaagaattaccacttgacgatcaaatcctcgaaggcggccgcgtccgcatggacgtcgattcccacaccgtcaccgtcggtggcgaaccagtgagcatgccactgaaggaattcgaccttctggagtacctcctccgaaacgccggccgagtcctcacccgcggacagctcatcgaccgaatttggggcgcagattacgtcggcgacaccaaaaccctcgacgttcatgtcaaaaggttgcgttccaagatcgaagaagagccatctcgccctcgttacctcgtgaccgtgcgtggattgggctacaaattcgagctgtagggctctgttaggccctgttgggcgctcaacttagttaaaaccagacacacgtgcccacggttcgggttttccgagttggtgggcactctggtttggtttatcgctttcgaaaccggtcccagttgcccaagtgtttcgatttgaggattcgtgggcacacctgtctggtcggggtgaaaagttggccttggacctgaaaatgtcgactcgctgtatggccgttagacgcacttccgtgatccactttaggggaacgttccttcgaaaaactcgaccgcttaaacgggcttctagagtgttgatgctttaaggggccgtaaatgtagggttctttggatgggagctaaggccagggctcacttttgctttgatcgggaggctccaagccagcaaaccagacacacgtgcccgcggttcgggtttttcgagttggtgggcactctggtttggtttatcgctttcgaaaccggtcccagttgcccaagtgtttcgatttgaggattcgtgggcacgcctgtctggttggccagaaaaactggccttagacccaaaaaaccagactcgctgtatggctgttagacgcgcttccgtgactcactttaggggaacgttccttcgaaaaactcgaccctttaaacgggcttctagagccttggaaccatttggacttcttcggagtctaaccagagtatggacaacaataattcctacctctggccagtaacctacgacgaagtctcccatgaattaaccaagtggaagttctacaaacacttcaccaaaatctcaggatcggtgtatttaaagaacgatctgatcgatgatcctgttttagtcacccaagcactcataaagagatgccctcaaggagtgctgaggggatatgcggcattgaatcgaagaggatatcaactattcgacgacccttggatgcccataattagcatttcgggtgagcctcgcacgagaaaaacaaccaacgtcggaaaaatcattcgtcgcgaaacccctgaaaatctaaggcgtagtggggaattcacgctcgtgagtgattcccaagcacttttggatgtgtttagtttgcacgggctcgatagttttgagcatcaggtggcgttgatcgatcatctgattaggcagtgtccggatttgaaggatgagatcaaaaaggttcctgaactgcggaaacatgcggaatttacggatgagtttgcggagtcgccaccggagtcgagattgcgggtgcgtcttcatatgcaggggtaccggaattttatgccgcaggttcgtgtggaattggaggggaggaggttttatttggatttggcggatccggtgtggggtgtcgcgttggaatataacggtgggtggcattacaccgctgagcagaggtcgaaggatgcgtttcggaagaatgctctgaagaatgcggggtgggatgtttttgaggtgacttctaagacgttgcagagtcagcaggcgtgggattatttctttcagcaggtcagggtggcgattcagcggaagtatgcggatcgtaagaggaggttgccgatgcagactgttagttgattgcttccaaaggggagattcgggaggctcggttggctgggatgagggctgctatgcctccgatgatgattgcggagatgagcattaatccgatttgggtccaggggaattcgacgggtgccatgcctcgggtgcggagacaactgacgattgcccagccgataaatgtacctaggaggagtccgtggattgcgccgtggatggagaggatgacggattcgagggtaatcatgcggcggatttgtcctcgttggacgccggtggcgcggaggattccgatttcgcgggtgcgttcgctgatggagaggaacagtgtgttgacgattcccaggactgcgatgatcactgccagggcgagcagtccgtagatgatgccgagcaattggttgatttgggtgccgaggcttccgcggaattcatctttggatttcacttggacgatgaggaagggggctacggcgtcgacgaggatgtcgcggagttcttcgttggtggtggagccgtcgccgttgacgaagatttgggaccggtggtaggtgtccgcggaggtgaggactcggttggtggcggctgcgttgaccatgaggtgtccgacgaggttggtttctgcgtagatgccggtgatggggacgcggatgccgtcgtcggatccgtaggggttgacggtgacggtgtcgcctacttcgaggtcggattggtcggcgtaggtggtggagatcatgacgccgggggtttcgtcgtcgaaggcgtcgccggagcggactgcgaggtcgaggaactgagagaggtcgccgtcgaaaattgtggtgttttcgttgtcccatccgttgacttggacgctgccggtcatgagggtgcccactttgccgactccgcgggtttgtgcgatttcctgtgcgacggctgcggacatggacagtgaccttgaaccgccggcgggttgtccagggatcatggtgccaccgatgctgtcgaggacatatggggatttgatggtggattccatggacccgaagacgctggcgcgggtggtggcgccgatgactccaacgcaggcgacgaggccaacgctcaaagtgacggccagtgcggtggttgcggagcgtcgcggattgcgcagggtgttgcgttgtgcgagcttgccgacggctcggaacggcgacattatcgccacgccaagagtctgagaggtcgccaccatcagtgcgggaccggacagggagagtgagaagaacactaagagaagtccagcgccgatgaatgcgaggcgtgtttctgttttgaattcatctccgttgatggcggataccacggcacctgcgatcgtcaggctgattccaagggtgagcatgacggcggcgacgaggaagcggatccttccgagggcgtcgctgcgtgcatcggaggattcgaatgcttggactggtgggaggttaccggcgcggtgagcaggcgatatggagcttagtacggtggcagtgacggcgaagaggacagggaagatgaaggatccggcgttgtaggtgatgtcgatggaggagagggtgtcgccgaattggttgagcacttggacaagtgcattgaccactccgaagccaactgcgatgccgatgaaaccgccgataagtccgacgaatactgcttccataatcacggagaatccgatttggaacgtggagacaccaatggaacggaggagggcgaattcgccggtgcgttgggcgacgatcatcgcgaaggtgttggcaatgatgaacgagccaacaatcagtgcgatcgcggcgaatgccaggagcacgtaggtcatgaactccagttggcgggcggtgtcgccggtggtttggtcgatgatttgctcgggcagcaggggcaggaggtcgcggtggtttttgccgatgcggttgcggactgccatggggtcggcgccgtcgttgactgcgatggtgatttggctggcgtcggtgccgttggtgaacagttcgacgtagcgctgtggggtgaatccgactccgacccagcctgcgacgtcggtgtttgattcgaaggttccagacagggtggcgtcgatgcgttcggtgggtgtgacgatcgttaggtgatcaccgagggagagcccgccacgtttggcggccgaagcgttgactactacctcgtcgggttttgtggggaagtggccgtcgataagcgttggctcgggcgagacccactcgccctgcggataaatggctagcgggtgcgtgccggagctgcctgcttgcaggggattgccgtcggagtcggtgaggatcagcgcggattggccggtcatggtggtgccggagggcatgccggggccgtcgccgatgatgttgacggcgcggacttccggatactgctcaatttcggcgatgacggagaaaggtacgccgtcggggttgttttgttgcgcgataacgcccacgtcaacgccctccacgccggcatcaacgatggaggaaaatgttctttcaagggaatgtgtgaggaggagggagccacacaaaaatgcggttcctagcacaaccgaaagcactgttaatgccatgcggagtttattcgccacaacgctgcgccacgtgatggtgcgcagcggcgaatttagaaaagccttagccgtttttaagacggtgataattttcctccttggtgaactccttaaagtttaaccgcgaggagtctcattattgttactcgcagaagctgggtgctgggctcgcaaatgtgctgggatggctgatcgtgcttccaaatatttacgtaacacctcgtaggagtttggtcccatgagtgcacggagttctgtttcctgtgttttccacatgggttcggcattggtgtggcagcgcggagaggtggtgcagtaccagtcgaaatcctcgccgccgttgccccagccgcgccggttgtattcagtaattgtggtgcgcaagatttcttgcccgtcggggcgctcttcccaggcctccaggcggcgcagcgggagctgccaacaaacttcaggcttgacgacggttagatcctcatttgcgttcacgccccactgatgcagcgcacaccccgcgcctgtttcccaacccgccctgttggcaaaaatacaggcgccgttgaccacagttgtcttcaaagcgggctcgggattgccgtcttcatcatctaattcatcccatgtcagccacggctcaatgtcggtgccgtcatcggatgctaaaaacgagtccgtggaggcggggcgtagctgccaatacttagcgggcatctgagcaacggcatcataaagctgatctcgatctgtctcatctgctaagaatgcaccgtggccgcaacaacccacgtcggcgttttcggaatcaatacctaaacaatcgggggtaccaaaggtgcaattccaattagactcaagccacgttaaatcgatgctaaatacatgctcaatatcagttggatccgtgaattcataccattcacgtgggaaatcaagagggagttcctccccagcacgaatcgatgccgccgctggcgaagactcggggaaacctaaaaataccgaagaagaatttgaccgattcacactttgccaccctagaccgtctaacctttaggtgtgagattaggtgtattagatgtgggcagcaatactgtccacctagttgcagtagacgcgcgtcccggtggacaccccaccccgatgagcaattggcgtaccccactgcgccttgttgagcttcttgatgactccggggcgatctccgaaaagggcatcaacaaactcacctcagcagtcggggaagcagcagacctagcgaaaacgctcggctgcgctgaactgatgccatttgctacatcggcagtccgctccgccaccaacagcgaggcagtgctcgaccacgtggagaaggaaaccggcgtccgcctgtccatcctttccggtgaagacgaagcacgccaaactttcctcgcagttcgacgttggtatggatggtccgcagggcgcataactaacctcgacatcggtggcggctccctggaactatcctccggaaccgacgaatccccagacctcgcgttctcactggatctgggtgcgggccgcttgacccacaactggttcgacaccgatccaccggcacgtaagaaaatcaacctcctgcgcgattatatcgatgcggaacttgcagaacccgcccgccagatgcgcaccctagggcccgcgcgcctggcagtgggaacatccaaaactttccgcaccctggcacgactgactggtgctgcgccctcatccgcaggaccacacgtcacccgaaccctcaccgcgccgggtctgcgccagctgatcgcatttatctcacgaatgactgcggcggaccgcgctgagctggaaggtatcagctcggatcggtcacatcagatcgtggcaggtgcgctagttgcggaagctgcgatgcgtgcgttggatattgacaaggtagaaatttgtccgtgggcacttcgtgaaggtgtgatcctcaccaggatcgacaaaggactcgagtaacatttacccggaaaggagttggcgaaaatgagtgaagagaaactcacagtcgctgagctgatggcgcgtgccgcgaaagagggacgctccaccgatgctccccgacgacgcaggcgccgcagcatcgaagacggtggcgtatccgttgctgagctgaccggctccattcctgccgttaaggaaaagcccgcggagtccaagcactccagcgtgcccatcgatgcaccagcagaacctgaggttgttgaggcccccaagcctgagcccgccgaagaagtagaagtggcttcggtggagggcgacgtcgataagcaggaaacccctgagcgtccggcgccgagcaacgaagaaaccatggtgctgcgcatcgtggatgaaaaagatccaattagcttgacgacgggcgcgttccccgtggttccggcagttgccgccaagccggcgcccgtagtgcgcgcggagaaggacgccgatgtggagactgccgtaaaggcagatttcgcagaggtggaagtcgataacactgacaccacgcagatggctgtggtggaagaagttgacgaggagccagagcaagaaaacaaaatgtccgtattcgcgatcatcatgatggcgatcgtcggagttgttctcggtgtcgttgtattcctcggctttgaaatgctgtgggagcgcctgaacaagtggatcgtcgctgttctggcagtcggcgtgaccttgggaatggtgggcatcatccacgctttgcgcacctcacgtgatggtttcagcatggttctcgcaggaatcgtgggcctggtcatgacgttcgggccgctggcaatcgtcatgtaatttgtcgttttgggcccccgctgctgcaaaacaggggtggttagtggcagtgtgggaaccatgacaacaattgctgtaatcggcggcggacaaatcggcgaggctttagtctcaggtttgatcgcggccaacatgaatccacaaaatattcgcgtcaccaaccgttcggaagagcgcggccaagagctgcgtgaccgctacggcatcctcaacatgacggataattcccaagccgcagacgaagccgacgtggtgttcctgtgcgtgaagccgaaatttatcgtcgaagtgctctccgaaatcaccggcactttggataacaactccgcacaaagtgttgtggtcagcatggccgcaggcatcagcatcgctgccatggaagaaagcgcctctgcggggctccccgtcgtgcgcgtcatgccgaacactccaatgctcgtgggcaagggcatgtcgactgtcaccaaaggccgctacgttgacgcggaacagttggaacaagtcaaggacttgttgagcaccgttggagacgtcctcgaagtcgcggaatcagacatcgacgcagtcaccgcgatgtccggatcctcccctgcatacctgttccttgtgaccgaagcgctcattgaggcaggagttaatctaggcctgccccgcgcgaccgctaaaaagctcgctgtggcctcattcgaaggtgctgcaaccatgatgaaggaaaccggcaaagaaccctcagaattgcgcgcaggcgtttcctcacccgcaggcaccaccgtcgcagccatccgagaactcgaagaaagcggaatccgaggcgctttctaccgcgcagcccaagcttgcgccgaccgatctgaagaactcggaaagcgctagaaaccgttatttccccgttatcagctcgttgtttaggaagaaattcacgaaaacgtttttcttccaccaactccaatgacctgcagattcacattcgaaactattaataacgggcgaaacacccgcgtgtttaaacaacaattgtcgcactattcacacaaatcacgctaagctgaaccaggcaaaagcgtgatcgtactgcgggaggggaagcccgcagcgcgcgaattgctgaagggtaatgatatatatggctagagaagataacggaaccttcctgacagtcgccgaggtcgcagaaatcatgcgcgtctccaaaatgactgtctaccgattggttcactccggagaactcccggcagttcgcgtgggacgatcatttcgtgtccacgagaaagctgtcaacgagtacctggactcctccttctacgaggctggctagactccacaacagcaaaaacctctccacgtaactcccggataacacctccgaaagtgacgtagagaggtttttctgtttgttcgcccggcatgatgattttggggttttgttgaggtgtttttgaggtgtttttggtgctcaatagtcttaaaggtaagatggaaaaatcgtgccagcgcacacccttggaaatgccatcgcggatacttccgatggtgtagcacgcgggttagatttttgctcgcgatccgaaagtgcacttcggcaaaaagtgctggcaggttttgtacgtacaacatcgatttaagcgagggaaaccgtaatgggttctgtcatcaagaagcgccgcaagcgcatgtccaagaagaagcaccgcaagatgctgcgccgtactcgtgtccagcgtagaaaattgggcaagtaagccttcaattgagcttcaaactagcaccgcctttcggggcggtgcttttttgtgtcttgggtggggtgcgttggggattttttatgggttctttgtgggttcgggggtctcaaactccccgggaaagcgattcgggtgctggggttttggaaaacgtgcgtattgaaccaaggagcacttctctggacgagcttttggtctgaatctgcagtttcgccgcctcgaaatgtgcaaatgagaccaaggaccggcttggcccaggtagttttggtttaaaacggcagtctgctcgaaacagcagcgaggaacccagagatcatgacctctcagattggcgtttaagcgcttgaaacgccgaaacccgcactaatcccatcggagaattcggacctcttaaaacggctcctgtgcgttattgttttctccatcggcggcgtagtctccagccggcgacactgaatgcggcggtgaccagggcggggattccgtattcgcgggtggctttgcggatgcttcggaaatcgcggacgtcccagcctcgggtttcggcttctttgcggagtttggagtcggggtttactgcgacggcggtgccgaccatggagagcatggggaggtcgttgatggagtcggagtaggcggtgcatcgggtgaggtcgagttgttcgatggatgcgagtgctgcgactgcgtgtcttttgccgggtccgtggaggatgtcgccgacgagtcggccggtgaatactccatcttttgcttctgcgactgtgccgatcgctccggtgaagccgaggcgttgtgccaggatttgggcgagttggacgggggttgcggagacgagccagacttggtggccggcggcgatgtgcatgtcggcgagttgtttggtgccgggccacattttgtcggccatgcgttggtcgacgatttcttcgcagaggtcaactagttcttggacggggcggcctttgatgaattcgagggcttgttcgcggccgcgggagacgtcttcggcgttttcggagccggtgagtttgaatttcacttgtttccacaccacggggaggatttctttgatggtgaagaatttcttccggaagagtccttgggcgaaaacgatgagggaggagccttggatgagggtgttgtcgacgtcgaaaaatgctgcggctccgacatcttgggggacatcgggatcggggatgctgacgtggatggcgccggcagattcgatggcgccggcgacggcgtcgacacctgcgttgaattcgttgagctccatgccgtagatcgctgcgacggcttgggttgctgcggcttcacctgcttggcgctgggcggcatcgtttatgggggcggctgcgtggtcttcgaaaaagcgtcgtagatttccgcgggatgcgctccagctggcgaggaaatcctctggggtgccgatggcggcgtagtcccagttgtggtttcttccttcagagctcatgagacaaacaaaaaccttcctggttcatgagcgcacagacgccaaaccgataatggatatctccattgagtatcgtatccatggtaaagctttcggggcggatacgctcgcgaagggtagtgaaatgtgagggagtgggcgcaaccatgggccattcggtggagatcattgttcgggacaattgtggctcgtgtgttcgggtgaaagcccagattttgccgattgttgaggctgccggaattaaactcactgagcgaaatgttgatcaagatgcgagccttaaactggaattcggtgatcgcgtgccagtcattttggtagatgatgaagagttcgcatgttgggaagtggataacgacgagttagccaatgctttgttgtgatgtccgcgaatgaaagctaccgtattttaatcaactaggattcattcttttggtggatcaaaggctccgttgaaagtcgggtggaatggtgagtgtactcatcgtagggatgtcgcacaggtctgcgcctgtgtcgcttcttgaacgtctgagcatggatgattcagtacgtggtgaaacaactcaagcactcctgggtagggcgtctttaagcgaggccctcattgtctctacgtgtaaccgcctggaggtctacaccgtcactagcagtttccatactggtgttaatgatgtggtggaggttctccatgaggcaagtggcgtagatattgaaactttgcgcggatatctttatgtccgttacgccgatgctgctgctgaacacatgttggtggtgacttccgggttggattccatggtgttgggtgagcagcagatcattggtcaggtgcgcactgcgtaccaagcagctaatgaatatggttctgtcggtcctgctttgcattcacttacccagaccgcgctgcataccggcaagcgcgtgcattcggagactgctattgatgatgctggtgcatcgatggtgtctttcgctgtggatcgcgcgttggtgcagatgggtcttgattcggaggcagaagccccactatctggcaagacagccttggtgttgggcgctggcgcgatgagttctcttgcagccactcaccttggtcgcgctggaatttccaacttgatcatggccaaccgcactctggaacgtgccgaaaggcttgcggagcattccctagaagccggagttcctgcagaggttgtggaatacgatcagcgagcttccgcctacaatcgcgttgacctggtagtttccgccacgggagcggatgatttcaccgtgaagcctgaggatattccagaaggtgcttcgttgatgttggtggatttgtccatgccacgagacatcgatgatgcttgtgcggatctgccgggcgttgatttggtgaacatcgaacgcctgcacaaggcctcccgtgagggtggatcgggcatggcgccaagcgaggaagaagctttggcgattgttcgggaagagttggattctttcacctctgagcagcgcattcgcgatatcgttccagctgtgtccgcgttgcgcaggcaggccgcgtcggtgggaagcgatgaattggatcgactccgccaacgtgcccccgggatttccgaggtggaatggggggaagtggagaaaacagtgagacgggtcgtcgataagcttcttcatgaacccactgtgcgcgtcaaggaactggcggcccggtccggcagcatctcttatgattcagctctgcaagagctgttcggtttggagtcgctggcgagcaccgcagcaccggcaaccacgtccgtcaacgcgtcagaactgccggatgcgggtatcgtcgcattcgtgaacgcaccttctgccacacaaacgagggagtaacatgaccttaaaaattggtacccgaggatccaaacttgccaccacccaagctggcaccatccgcgaccagctgaaacactacggacgcgacgctgaactgcacatcgtgaccacccctggtgatgtcaacatgtccccagtcgagcgtatcggcgtcggcgtgttcacccaggcgctgcgcgatgtgttgcattccggtgaatgcgatgtggctgtgcactccatgaaggatctgccgaccgccaccgatcctcgattccacctggtcgtgccaactcgtgcggactcgcgcgaggcccttatcgcccgcgacggcctgactctggctgagcttccagaaggcgcaaaggtgggaacttccgctcctcgacgcatctcccagctcaaggcaatccgccctgacctggagattctcccactgcgcggaaacattgacacccgcatgggcaaggtcacctccggtgaactcgatgctgtgatgctcgcctacgcaggcctcacccgcgtcggcatgcaggaccgcgcaacggaagttttcgacgccgacatcatcatgcccgcccccgcacagggcgcacttgcgatcgaatgccgcgccgacgacactgaaaccgtccgcgcgctcaacatgctgatgcacgccgacacgtttgtttccgcggttgcagaacgcaccgtgctcaaccgcctcgaagctggctgtaccgcgcctgtcgcagcgcacgccaccttggacggctactccggcgacaccatgactctcaccgccggcgtctacgcacttgacggctctgaccagctggtattctccgccgaaggtgacggcgcccgcccagaagagctcggcgagctcgttgcacaacagcttatcgacgccggagccgccaatttgctcggcgaccgcagctaattagggcccgaaatttccatattgagggcgtagcgaaagaatgtgcgaatatccaccacaaatggctgattagggggcggtttgtggtggatttttgcaacttccacggcctgtggtgcaaaaatctgttcgattttaaggtctggccacaggattgtggtgaatccttgatcagggaacctgcaggaatcacacctgtctcattcgcaacaaaccgtaggtgcctcagaatcgtttttaaggccataaacgggcctcatccatatgtggacctattttggggatgttgaccccttaaagtgaattgtttgggaatacttatgtgactcgcaggtatttgggggcgttacatgccacaattggtggggtcgtttaaccgccgcacagtcggcagaaaagagcttgatcgttgtggctgagttgagaatcaataatcgtatcgtgactgttcatttgtcatggtgggagaagttgagtgctaggcgtagccatttgaggattcctcggaaagcaatccggaacattcaggttgtagacaatgtcatcagttcagttgaccgtcccattaagcgcactggtcgtttgcgtattccgggggtctttgtggctggcactcatgcgtatgtcaatgaaactctttcggaaaatgagttcagcatgtgccgaaagaatgaacctggtttggtcattgagctggagaacatcagcatcgatcgcattgtcatttccacaccagatgcccaccgctatgcggatgagctcatggcggctgtttagaactcagtttccgtcaataaatttctggatcagggccttcaccgcgggggtgggttgggggttccaggtgatccaggtgcgaacaacaaggtcatttccggaggcgtcttcgccttcgatggggacccattgccagctggggaagttggtgcgggcggattcctctgttgtgagtgcgacatcggcctggacaaggtctgcgatcagtgagctatattgcccaaattttcggaagatccacgtggcattaactcctgcggcgagcatggcgtttttgaggatttcttcctgaattcttacttcaccgcgggagtgtgcgaggactcgaagcccttcaagatcgaagagtgtggcgttgtcttttcctgcgactttttggtgcagttcggagttttttcggacgacgattcccagttcttgttcgtggacaagtgtggtggcaaaggcctcgctttggcgtcgacaaagggcgatgtcgagttcgcgttgtttaagaagttttagctgatcatcggtgggggattcgatcagtgaaatgcgggtctcggggcctaaatcgatgagttggcagcgcaaccagtcgatggggattccagggggaactccgatgttgatgctggtgatgaggtgctcaccggattggatttcatcgactaccgattgcatcctgctaagcgttcggagggcttcttcgtggaggatttctccggcctttgtgagggagacaccgcgggaatggcgttcgaagagtggagctccgacggatttttcaagtgcggagatctgtcggctgagagcgggttgggaaatgaggagttcttcggcggcgcggttgatctgtccgtgttgggctactgcgatgaaaaattcgagctgattgaggtgcatgtgtgctaaacctttcggccggtatgcaagagatggatatcacggttaatgtttatgcatttgtactatagatcacaattgcttagagttcagggaaagggtcatacatccaccccttctgagaagttaaaagtagggacgccaacacaattggcagaatttagaacttcaatgcattacccacaatttcaatcggtttatacaaccagcctctaactggcaacaggactgcagacagaaactgttgctggaaccttcgatgaacaggatcgacaatgagcgaacaacttcagggtgtaactcactccgaatcaactccgggcaagacgcccaagcgagcagcactatccagctggatcggctcagctctcgaatactacgacttcgctgtttacggaaccgctgcagcgctggttcttaaccacctcttcttcccagctgatacttcaccaggcatcgcaattttggctgcgatgggtaccgtgggtgttgcttatgtggttcgccctcttggtgcgctgatcatgggtccattaggtgaccgttacggacgtaaatttgtcctcatgctgtgcctcttcctgattggagcatccactttcgcagttggctgcttgccaacatttgatcaggtcggttacttggctccggcactgttggtgctgtgccgtgtgatccagggactgtctgcatccggtgagcagtccagtgcgatttccgtttctttggagcacgccgatgagcgtcaccgcgcatttactgctagctggactcttcacggaacccagttcggtaccttgctggcaaccggagtatttatcccattcaccttgttcctgagtgaagatgctctaatgtcatggggttggcgcgttccgttctggctgtccgctgctgttgttttggttgctttcctcatccgtcgtggactggaagagccaccagcattccgtgaaaacaaggaagcagttgcaggcgcagcatctccactggcgatgaccttgcgttaccacaaggcggcggttgctcgcgttgctattgctgcgatgatcaactccgtgaacattgtgtttactgtgtgggcactgtcgttcgccaccaacattgttggcctggatcgttcaactgttttgctggttccagttgttgcgaacttggttgcactgattgcgattcctttgtccggcatgctggctgaccgcattggtcgccgaccagtgttcatcatgggtgccattggtggtggcctggccatgaacggttacctgggagctatctactccggcaattggaccatgatcttcttcatgggcgtgttgatgtctggtctgctgtactccatgggtaatgccgtgtggccagcgttctacgcagaaatgttcccaacctctgtgcgtgtcaccggcttggctcttggaactcagattggtttcgcagtctctggtggtttcgtcccagttatcgcatccgcgcttgctggtgatcagggtgaccagtggatgaaggtgtccatcttcgttggtgttgtttgtgtgatttctgcactggttgccatgaccgctaaggaaaccaaggctctgactctggatgagatcgatgctctgcacactgctggtggtgaggccgcagacctggcagccgcaagcaaagcctccgaggcccaactcgcggctcagtaaaaccaaaaggaatctttgaccacatgcgtacatccattgccactgtttgtttgtccggaactcttgctgaaaagctgcgcgcagctgcagatgctggatttgatggtgtggaaatcttcgagcaggacttggtggtttccccgcattcggcagagcagattcgtcagcgggctcaggatttgggattaaccctggatctgttccagccgtttcgagatttcgaaggtgtggaagaagagcagtttctgaagaatctgcaccgcttggaagagaagttcaagctgatgaacaggcttggcattgagatgatcttgttgtgttccaatgtgggcaccgcgaccatcaatgatgatgaccttttcgtggagcagttgcatcgtgcagcagatttggctgagaagtacaacgtcaagattgcttatgaagcgttggcgtggggcaagtttgtcaatgattttgagcatgcgcatgcacttgtggagaaggtgaatcacaaggcgctgggaacctgcttggatacgttccatattctttcccgtggttgggaaaccgacgaggtggagaacatccctgcggagaagatcttctttgttcagttagcggatgcgccgaagctgagcatggacattttgtcctggtcgcgtcaccaccgtgttttccctggtgaaggcgatttcgatctggtgaaattcatggttcatctggccaagacgggttatgatggcccgatttctttggagatcttcaacgattccttccgcaaggccgaggttggtcgcaccgcgattgatgggttgcgttctttgcgttggttggaagatcagacctggcatgcgctaaatgctgaggatcgtccaagcgctcttgaactgcgtgcacttcctgaggtcgcggaacctgagggtgttgatttcattgagatcgccactggacgtttgggtgagaccattcgggttcttcatcaattgggtttccgcttgggtggtcatcactgcagtaagcaggattaccaggtatggacccagggcgatgtgcgcattgtggtgtgtgatcgtggggtcaccggggctccaaccacgatctctgcgatgggctttgacacccccgatccagaagctgctcatgcccgtgcggaattgctgcgggctcagacaattgatcgtccccacatcgagggcgaagttgacctaaaaggtgtgtacgcaccggatggggtggagctgtttttcgcggggccgagccccgatggaatgcccgagtggctgccggaattcggcgtcgaaaagcaagaagctggtctcattgaagccatcgaccacgtcaatttcgcccagccgtggcaacattttgatgaggcagtgctgttttacaccgcgctgatggcgttggagactgtgcgtgaggatgagttcccgagcccaattggtttggtgcgcaatcaggtgatgcgttcgccgaatgatgcggtgcggttgctgctcagcgtggcgccggaggacggtgagcagggagatttcctcaacgcggcctacccggagcacattgcgttggccacggcggacatcgtggcggtggctgaacgtgcgcgcaaacgaggcctggatttcttgcccgtcccagagaattactacgacgatgtgcaggcgcgttttgatttgccgcaggaattcttggacacactcaaggaaaaccacctgctttacgaccgcgacgagaacggcgaattcctccacttttacacccgcacgttgggcacgctgttcttcgaagtggtggaacgccgcggcggttttgcaggttggggcgaaacaaacgctccggtgcggttggcggcgcagtatcgtgaggtgcgggacctcgagcggggaatcccaaactagcatcccgaactagccccccaacaacaattagaaatggaacctaaaatgcctggaaaaattctcctcctcaacggcccaaacctgaacatgctgggcaaacgcgagcctgacatttacggacacgacaccttggaagacgtcgtcgcgctggcaaccgctgaggctgcgaagcacggccttgaggttgaggcgctgcagagcaatcacgaaggtgagctaatcgatgcgctgcacaacgctcgcggcacccacatcggttgcgtgattaaccccggcggcctgactcacacttcggtggcgcttttggatgctgtgaaggcgtctgagcttcctaccgttgaggtgcacatttccaatccgcatgcccgtgaagagttccgccaccattcttacatttccctcgccgcggtctccgttatcgctggcgctggcatccagggttaccgtttcgcggtcgatatcctggcaaatctcaaaaagtagaaagcccaaaaatatgaacgacagtattctcctcggcctaatcggccagggcctcgacctatcgcgcacccccgcaatgcacgaggcggaaggcctcgcgcagggacgtgcgacggtgtacaggcgcatcgacacgcttgggtcgcgtgcttccgggcaagatttaaagacgcttctcgacgccgccctctaccttggcttcaacggcctgaacatcactcacccgtacaaacaagcagtattacccctgcttgacgaagtctccgaacaagccacccaactcggcgcagtgaatactgtcgttatcgacgccaccggccacaccaccggccacaacaccgacgtctccggatttggccgcggaatggaagaaggcctccccaacgccaagctcgattccgtcgtgcaggtcggcgccggcggcgtaggaaacgcagtggcatacgccctggtcacccacggtgtgcagaaacttcaggtcgctgacctcgacacttcccgcgcgcaggcactggcagatgtcatcaacaacgcagtcggccgtgaagccgtcgtgggagtagacgcccgcggcatcgaagacgtcatcgccgccgccgacggagtagtcaacgcaacccccatgggaatgccagcacaccccggcaccgcctttgatgtcagctgcctcaccaaggatcactgggttggcgacgtcgtgtacatgcccatcgaaactgaacttctcaaagccgcccgtgccctcggctgcgaaaccctcgacggaacccgcatggcaatccaccaagccgtcgatgccttccgactgttcaccggcctcgaacccgacgtctcccgcatgcgggaaactttcctgtccctctaaaagagtcagtaaaacctcgacgcttcgaccgtttccttcgcttccttcaaccctgccccggtaagttcacggtgacgtttgatcgccgcgatcttcttaccctgctgcaggagcgccacaacgtcaggatgtaaccctgattgtggtctttgcaacgacagcggaatcgaagaatcaccccctagctgagcaatgatccgatcttgctcagctagtctgcgttcaagagcagcaacacgagcttccaaagcactgagatttacgtcttttctgccaaacatgcccccacaataggtgagtgcttagtttcgggggtgtcccatgctcaacttcgcgtcatacgacttcagtaggaaatccggtgatcgcctaatgaagtctacacatgagaagtcgccctttaaggtgatcaaatgcctctttggctcaccagcagtcgaaaaccaaaccaggtgaccgagattccctgaggaaaaagttttcggtcacctagtttggtctgcctagattcacagtaaagaacccggaaaacatgccctcgcagaatcgcgtctaagcccctaaaacgcctcgacccatacttagacccatccgcgaaattggaccccttaaaattaggcgtcagtattaggccaaggagcacttttcttggggagcttttggtctcaaactgcagtttcgtcgcctcgaaatgtgcaaatgagaccaaggcaccacatcgccgccgccgttttggtttaatccgcgcggtagaccatcgggttgtcgatgctgagcccgatggtttcgccgatttcggggagggagcaagtgatggacattcggaaactgtgtccgctctgggttttcgcggtcacggaataggacgtgacctggaacagcaccgaggtgatctccgcgaaaatgtaatcggggtgatgagcggggccgatgtcaacggagtggggtgggatcgcgatgtcgacgaggtcgccgtcgaaaatgtcatcaatcgcctgtactgcgtctagatcccaagaagtatcgagatcaggacacatcactctgccatttcgaacaattccattcaggacggtggcgtcgacgatgaatcgggcaacatcggcagtagcgggggcggaaaggagctcagtaggggtggctacctgttggattcgaccgttgccgagtacgacgatgcggtcagcgatggagatcgcttcggcgcggtcatgcgtcacgtgcacagtagtgaggccttcgcgccgggtcaaagatacgagttcgcgtcgtaaagcgtctcgcagcggttcgtcgagggcggagagggcctcgtcgagaagcagcacggtggggtcggcgatgatggcgcgcgcaagcgccacccgctgacgttgaccaccagacaggctggccggtctgcgactgccgaacccctcaagccccaccagcgcgagcgtgcgctccacgcgtttgcttatcgacgcccccttctgaccacttcgcgccagcgggtatcccacattcttggcgaccgacatatgcggccacaccgcatgctgctgaaacaccatgcccatgcgacggcgctccggcgggacatgcgtcatgtcttcgccgccgatgagcacactgccggaacttggctccacaaaccccgcgatggtgcgcaacatggtggttttaccggaccccgacggcccgatgagcaccacaaattcttccggctcaattttcaaattgatatcttgcagcccgaaggttccgtcgcggaagctcacgcttaaatcgcgcaatttgatcgatgacacctaaaactccttctggctgcgcaccgtcaacgcgagcgccacgataccgataatcgcaaacatcaacgacaacgccgatgcctgattgtaatttcccgcctgctgcaaattgaacacctgcacacccagggtggtggtgcccggcgcgatgagcaaaatggacacggttaactctcgaaccgcagttaccgcaaccagcactgcgccggcgaaagctgcgggaattgccatcgctccggtggtgtccatgatggatcgtaatctgcctgcgccgctgattcgtgcggcttcttcgattgcttcgggtgcttgactgagtggtccgcgtacagcttggacaaccagcgcggtaaaagcacacacatatgcacccaaaatcacccaaggtgtgttgtaaattccggtgtatctgcccaaaatgagccagccgacgccgatgatcatgcccggcagtgcggtgggaagcagcacagtgagtgtcaacggtacgttggcgaaatgctgggttcgggtgatgagcactccgatcagccatcccagcaccccacagattagggctgcacccagggataacatgagggagttgctgaatccttcgattactcgtggattgctcagtgctgcttcaaagttgttgagcgtgatgttgtctaggttgaacggcacacctggggcaggcagtaatgctctgtatgccagacccagcagcggggcggcggtgatgatcaacgcgatgatccacgtgatcacgctgactgggattcgtgatttgttgagagtaaagcgatgcggtgttcctgcgtcttgcaactttgatgccgcgtacaaagacaccagataatccgcggttactgctgcgattcccaggaacaacaacacgatgccaatggtggataccacctgcaatggattgctcacggtgccggattccatgaagcgataaatcatggtggctaaggtttcaaaacgcgctggcgatcccaacagagctggaatgccaaagtcggcgaggttcgccactgtggtaagagtaaacgccgacaacaatgcaggtttgagcagtgggagtgtgatggtgcgcaacaccgtaaaagtatccgcccccgcgatccgtgcagcttgctccaaatcactaggaagttgcctcagagctgccgaaacaatgatgtacacagtgggataggagtgcacaatcaacaaaaatgtcacaccatcagcgccgtaaatatcccacacttccgtgccgaaaaaccggttgatgccctggttcttcccgaacagctgcaaccacgcaatagccccaataaacggagggatcaacagcggggataacaaaaataaccgcaacgcggtgcgcccgaaaacatcagttcggtccagcgtgagagccatgatcgtgccgataatggtcgcgcccaccgcagaaagcactgttgtataggcggaattccatagggctttgcccaatccggaatcccacagagcaggaaactgattgcctcccaacgccaagcccaccaccagcgccaacggagtgataaacaaccccgcgacaatcagccacacacccagacgcatgaaagacaaagacgtcaacgcagagatgtgaaagcgctgcgtcgacgtatttgaaggagataactgcataggaaaactagttcattgcgttttggaagaactcaacagcagccgccttatcagcggttacaacctccaggtcaggggtcatgagctcgatgtcagccaactcgggggtgccctctggagttccgacatcttcacgcactggcaggtatgcctgctcaactgcgatttcctggccttcaacagacagcaggaagttgatgtagcgctcggctgcttccttcttttcagaatcagcgaacacacctgcaggctcagtgatgtaaggagaaccctccgatgcgtagatggtgtcgattggagatccagcagcagccaagtcgcgcaccaagtagtccaccacgatgcccactgggtggccaccgccagcgatctcctgggaggttgggccgttggactgagcgatcattggttggttttcacccaaggcggtgatccaggcttcgccaagcgcagggtcgttcttccacacagaagcattgaaggctgcagcaccagacacagctggatccggcatgaccagttggcctgcatacttaggatcagtcagatcagcccaagacgtaggaagctcagcctgatcaacaacttcagtgttgtatgcaatcacggttgggatgatgcgggtgcctacataaaagttctcagcatccagagcctcttcaatgatgtcggaagtctcaacatcttccagctctgcaaggtcgccctgtgctgcataagtttcaaaggttgcagcatccgcagcccacaacacatcagcctcgatagaaccggatgccttttcagcttcaatgcgagcagtcagatcgccagtaccagcgcggtacacctcaacctcaatatctgggttggcttccatgaacgccttgttgatctcatcgaccttttcctcaggctcagaggtgtagacggtgatggttactttttcaccggctgcatcggatgcgttagcggaagagcttgcagtggtggtctctgcggtggaaacgtcctcagaaggttcagagcaagccacgaggagagcagcggaagcgccgagtgcaaaaacagtaacggcagtgcgcttcaaagggtgcttcgaagacatgaaaataaggcccttcttgaaattttaaggagtgtttgggggaggaaataacatctttacatgaatgggcgcatttcgcaggacttatggaaatgtctgcacgtttggcgatgtttcagttagaccttgaaggggagacctacatgaagagaggtatttcacggattcaatcccttagatcgggagccctacaagcaactgcaatctgcagtgaactgcccaacaaaggggtgggttatgtgggtagggaaaagaattatttgtaccgctggcggaacatcaaaaagtgtttgtgctgaatctgcctgaacagcttgtatggtgcatgaaaggtgtgacccaggctgctaaaaggggacctaattaataggccaaaaatgccgtttggtaaaagcaagaattgaagcggtttttcaaaacaggcatgactcaattatcgtgtatataccacacggtaaacacctgttgagagggtggtcggtttttacgccaccaatgtttgaactggccgttttctttgaaaatcgcgctcggtttggatgccctcgtaaaataaggtgcaaatattgtgcgccgaccagttatgtcctcatccgacggcggtcagtgtgcttcattaaattgtcgtggacaatcccggatcgaaaatttgattcggcttttttcatggctgttgatggagtacgttggtcgttttcgagacaagtactagaaaagatattgatgactatcgcccataagcccgagatggctgaaactaccgggatcgagaccaaccaggtttccgaaaccatcggggttgaatcgctcacgcacggaaacttacgtcctgtttcatcttttgagggacagcatgagggacaaacggaagagttacttccaggcaaagtcatttttgttggggccggtcccggtaaccctgatcttcttacagttcgtgcccgtgaagttctgggcaacgcggttcgtgcgattactgatgaacaagtactaagcggcgttcgagcttttgtcgccactgaaattcctgtgccggaagataagcttcaggctgcggaagatgagtacgagcgcatctgcattgaagcgaaggagaacggtgcacgccgtaagcctcctcgtccagcaccaccaaccgctgcagagatcacggaagtttctgaggcgactccagctcagattgttgagcttgtgcaggatgctctttcttatggtggagatgttattcgtcttgtcaccggcaacccattgagcagcgatgccacactggctgagatctctgcagtttccgaggctggcctggagttccaggtggttccaggtatgtctttgcctgcaacggttcctgcatttgcgggaattgcgttgggttctacctacaccgaaactgatgtcaacggtcaaaacttggactgggatcagttggctagcgcacctcagcctttggtgctgcaggcccgcgtggatgacctttcccgtattgcacaggaactaaaggcccgcaatatgtctttggaaactcctgtttctgtcaccgctaacggcaccacccgtttgcagcgcacctatgacaccactttaggtctgttgcacaagcttgatgctgaactaagcggacctttggttgttaccttgggcaagggtgtggatgatcgctccaagtactcttggtgggaaaaccgcgctctgtacggttggcgtgtgctggtgcctcgcgctcgggagcaagcggcatccatgtccgcacgtctgagcagccacggcgctatcccgcaggaagtccctaccatttctgtcgaaccaccgcgcaacccagcgcaaatggaacgcgccatcaagggcatcgtcgaaggacgctaccagtgggttgtcctcaccagcgtcaacgcagtgaaggcagtctgggagaaaatcaccgaattcggcctcgattcacgttccttcgcgggcgtccgcatcgccgcagtcggtgaaaaaaccgccgctgagatccgcgcgctcggcatcacgccggagcttctgcctgcacgtaccaggcaaaatgcgcaagggcttgtcgacgtgttccccgaatatttcgaagaactcgatccagtcggccgtgtcctcttgccgcgcgcagatatcgcaaccgacgtgcttgtcgacggcctgacccaccttggttgggaagtcgaagacgtggtggcttaccgcaccgtccgcgcagcaccaccaagcgctgatatccgagatatgatcaagaccggcggatttgatgcagttgccttcacctcttcgtcgaccgtgaagaacctcgttggtatcgcgggtaaaccacacccacgcaccatcgtcgcgtgcatcggacccatgactgcagcgaccgctgaagaactgggactgcgcgttgatgtcatgccagagatcgccgaagtaccagaactgatcgacgctcttgcggaacacgtggcggatctgcgcgctaagggcgagctgccgccgccgaggaagaaacgcaggcgtcgaaaagcgtcttaaaaggtttttcactagggtgttgtccatggacatccagcagctagacgccgaaacaacagcatggaaagacagcctcctgcgcgccgcacaggaggctggttttcattttgagccaccgaaactcttcgaggattttgagaccatggtggagcagtacaagcaggcagctgcgagcgacccggacattgatgtcactgatattcagcaaatgtggggcatcgtggtgggggagtacctgcgcgaaaaaatgggcatggaatgggtcgtcatcaccgatgactacggcactgacctcgcgattctagccacggcacccaacggggaccacgtatattcctgccccatcatcgtggtgggcaagcgcttttcacccgactatgaacctggtcagctggagtttttctgcaatcaattcatggtgacgtcgctcgctcaactgcagtgaaaatagtagcggacgtggtcgtgtccaccgctgactctatgattggacaaaggacctagaaatttcaagagagcaaaggttacaagcaatgagcacttcttctgattactcccacgcactaattcgtcgtccgcgccgacttcgcgccaaccctgcgatgcgggaactagtcgcggaaaccgcattgcgcccggcggatcttattctgccaatgttctttgcggatggaatcactgaggcacgtgagatctcctccatgccgggcgtttatcagcacactgaagattcgctgctgcgtgccgcccatgaggctttagatgctggtgttcgttgcgttgatctgttcggtgttccagtggatgcggacaaggacttcaatggttcccaggcatggtctgaaaccggtgtgttgaaccgtgcactttcatcgctgcgtaaggaattcggcgatgacctgctgattatggccgatacttgccttgatgagttcacggatcatggtcactgcggcgtagttaccgaggaccgccatggaaacgcaatcgtggacaacgatgccactttgccgctgtaccagcagatggctgttgctcaggctcgtgccggtgcacatattgtgagcccttccggaatgatggacggccagatcgctgctattcgtgcagcgttggatgaggaaggctaccaggacgtcgccatcatggcgtattccgctaagtatgcatcagcattcttcggacctttccgcgaagcagtgggatcctccctccaaggcgatcgacgtacctaccagcaagatcctgcgaacctgcgtgagtctctccttgaggcagagctagatatcgcagaaggagcggacttcattatggtcaagcctgcactgccataccttgatgtgctgacccgcatcgctgatacctcacctgtcccagtggctgcctaccaagtttctggtgagtacgcgatgatccaagcagcaggccgcaacggttgggttgaccttgatgcagtgatgatggaatctttgacctccatcaagcgtgccggtgcaaaccaaatcctcacgtactttgccgttgacgctgcccgcgcactgcgaaacgcttaacaagaactaactgattagtaggactccccatgagcatgcttcccaatctcacaccgaagaaatctgccccgccttcatcttctgcttctgcgaaaaatgctggagaaaagaaggaagacaccgtcaagctcctgattcagatgtgggctgtgatgatcggtttggagctgctgcaccagatcttaaacgtggtgatgagctttacggacccgactgcgctgcggactgttgccaaagaacaagcagcagcacaggggctttccgatggcattgttaacgccacagtcatcgcagcaatcttggtcatgggattcttcaacctcattgtgattgccattttgtcctggatggtggtgatggtgaaaaaccgttccaaacgcctaccgacggcattcttgctgctcaccatcttcagtttcttctttatcctaagagtcttgatgctgtttttcgcctcacctggtgggactgatgttccaatggcactatttgctatcgacggttgtgtacaaatcctcgtcggagtgagcgccggtgtggcatatgcgctctcgcgcactgagcagcctgtcaaaatgctcaccgactacgcaccagaagacgctaaacggtaagtactgaagaatttttaaagacgacggagatttcaccacaatgccaagcatgttcccatcacccgcaactggcggagatgacatcaaccgacgccccctgaatgaaccaaacgcagatgcaaccaccatccccactgcactaaaagtggtgttctggatgctgtttgccactgcagcgttcatgatttttacaggcctggtgatgtacaccgccggatacacgggacctgatgatgtggatgagagctacaaagccgttgtggtgaacaaccaggagttcatcggtggcatcaatgcctttgctggcgtcgtgattgctgcacttacttcacaactgccaaagggcggcaagaatccgcgccgtcttttgttggccatcatgttgttggtattgctgacagatctgttgtcttttgccacccgcgctggaggcttcgcactcgcaatcatcgcagtcttgttggctttggaagcactcttgatgttccgcccagcagtcaatgatcacattgaccgaaatcatatggctcgtgtaatgaatcgcgagaagtagaacggttcgaccgtactttttcgctaccgtgagtcttaccgtgagccttatactgtgaggacattaaaagtgacacctctttttctatcttttacaacccaagaaggtttatcgtgagcacaccggattcttcctcggtggacaaggccgtaaacactgctatctctgacgccaaaacagcggcgctcaaggcaggtgttggattgaaccgagccaccgcctcagaagaagaggaagatttaagctcaagcattaaggtttctttggcctttgagctcgaggggttaagcaatgcaccatcgttgatggtggtggaaaaagccctagagaagatccccggtgtatccgcggatctgatttacccttcacaaactgcatggattacagcaactgatcgggtacatcccgaaaccctcattgaggtgtttgagcagttcggcatcaaagcacacctttctaattcatcgctgctgcgcaggcatcaacagctcagcgcggaagtaaatagggaagcacgccttgatcgttaccgctcccgaatggatgccaagcgaatctcgcctcgtgtgcgaaggcataaccgacaagaaatggtacatgcggtacgcgctcgtgaaagtggttggattaaacgcaggaatcacaccacctcgcagcatgaagacccaatgtcgggcgatgtgctgttcaccgcccgcgcactgattacacctaagcgtttgtgggtgtcgttgccgtttgcgctcatcgtattggcgttatcgttgaatccttcgtggcagtttgattattggcagtggttgtccgctgtgttggctattcctgtggtggtgtggggtgcctggccgtttcaccgcgctgcagcaggcggtattcgtcgaggaatttccgctcttgatgcgaccagctcaatcgctattgctgctgcatacgcgtggtctatcgccatgctgttgtttgaaaccccaggaggtaaatcctggcggtcatatccgtcctggttcgcttttgaccacggcacgttgacccaaaacgagatttattttgatgtggcctgcggaatcaccgtgttgcttcttgccggacggctgctgacaaggcgtcgaagccaatccagtttgttagcggaacttggtcgcctccaaatcgatccacagcgcattgtcactgtggtgcgtaaacaccgattgaagcgcgtagtccaggaactgaacattccagtgcaggaagtccgtgtcaatgacgatgtgaaagttccacctaataccacgatccctgtggatggcactgtcatcggtggcggttcgcggatcgcagctagcatcatcatgggacaagaccagcgtgatgtaaaagtaaatgacaaagttttcgccggcagcctcaacctcgaatccgaaatcaaggttcgtgttattcgcactggtcaccgcacccgcatcgccgcggtacataggtgggttaaagaagcgacgttgaaggaaaaccgccacaatagggcagcgatccgttcggccggtaaccttgtgcccatcacgttcacccttgctgtggtggacttctgtctgtgggcactgatctctggaaacatcaacgctgcatttaccactaccttggctgtccttgcgtgcgtggctccggtggccttagcgttgtctgctccacttgccacgaggaattccatcgaagctgcagcacgacacggtattttggtccgctctggtgaaattttccgagttctcgatgatgtggatactgccgtatttaatcgtgtgggcacactaaccgatggcgaaatgacagtggaaaccgtcacagcagacaaaggcgaggacccagaactagtgctgcgtgtcgccggggcgttggccatggaatcccaccacgcgatttccaaagcactggtgaaagcatcccgtgaagctcgtgataccggcgccggtggtgaagatgtcccacactggattgaagtaggcaacgtggaaatcaccgaagccggctcattccaagcaaccatcgagctgccactgatcaaaccatctggcgaaaaaatcatgcgcaccacagaagcactcctgtggcgaccacgatccatgacagaagtccgtgagcacttaagcccccgactagtggcagcagcaacctcaggtggcgcaccactgatcgtgcgatggaaaggcaaagaccgcggagttatcactctaagtgaccacgtgagatcagattcctccgatgcgattattgcgattgaagaacaaggcatcgagaccatgatgctttcacgtgatacttacccggtggcacgtcgatacgcagacagcttaggcatcacccacgtcttggccggcatcgcgccgggcaagaaagcccaggtcgtccgtgcagtccacacccgcggatccactgtcgcgatgatcggcgatgaatcagtaatggactgtttgaaagtcgctgacgtgggtgtactgatgggcgtcgatcgtccctcagatctgcgtgatgattccgatgacccggcagctgacgttgtggtcatgcgcgaagaggtcatgagcgtgccgacgctgtttaaactggctcgacgctacgccaagttggtcaatggcaatattgctctggcctggatctataacggtgttgccatggtgcttgcagtgtctggcttgctgcatccaatggctgcgaccgtggctatgctggcgtcttcgctgcttattgaatggcgctcgggcagggcgcgcaagtactaaccagcaattcccaagcccaaaaacccctcccatatagttctttttactgatgcattgtcctcaattaggtgtggcttcttttcctaaattgggataaatggggcaagattgagcgcatgtctgctcttactattccagctgcgcgtcgcacgctaaataacgcgcccattattgatgccgctaatggcaagaccccgactcgcactccggtgtggtttatgcgccaggcgggtaggtcgttgcctgagtacaagaaggtccgtgagggaatcagcatgttggattcctgtttcatgccggagttgttggcggagattactttgcagccggttcgtcgtcatgatgtggatgctgcgattttgttctctgacattgtggtgccgttgcgtgctgcgggtgttggtgtggaaatcgtggcgggtcgtggacctgtgttggatgcgccggtgcggagccgtggggatgtgttgaatcttcctattttggagggcaacgttccggaggtggagcagggtattggcatcattttggatgagttgtctgattctcaggcgttgattggttttgctggtgcgccgtttacgttggcgagttacttggttgagggtggtccttccaagaatcatgagaagaccaaagcaatgatgcatggtgatcctgagacgtggcatgcgttgatggctcgtttggtgccgacgattgtgaattctttgaagtcgcagatcgatgcgggtatcgatgcggtgcagttgtttgattcgtgggctgggttcctcactgagcgtgattacaccgagttcgtgttgccgtattccactgagattttggaggaagtgggcaagtaccagctgcctcgtattcactttggtgtgggtactggtgagttgcttggtgcgatgagcaaggctggctcagaggtcatgggtgtggattggcgggtgccgttggataaggctgcggagcgtattgctgcggtatcaggtcctaaggtgttgcagggtaacctcgatcctgcgttgttgtttgcgggtcgcgcacctttgactaaggaaattgagcgcatcaaggcagaggctcagactgctgttgatgcaggtcatgcaacgggccatatctttaaccttggtcatggtgtgcttcctaatacggtggcggaagatattactgaagccgtctccatcattcattcttaaactaagaggagtttcatgcgttttgccatcatcggtgcaggccttgcgggtctgactgctgcatatgagatccataaagctgatcccactgcccaaatcgatgtgttggaagcaggcgaacgcattggcggcaagctttttacggtgccgtttgcttccggacctaccgatattggagcggaggcgtttttagctgcgcgttccgatgcggtggagttttttactgagcttgggttggctgattctttggtcagcccgtctgctgcgaagtctcagtatttcgcgggcggtgcgctgcatgcgttccccgcaggtggagtgatgggtattccaagcaatccaccagcaggcgcgcaagacaccgcttttgattggactcctggccaagacatttctgttggcgccttagtgcgccgtcagtatggcgatgagatcgtcgatactgtggtgtcttcgctgcttggtggcgtttattcctccaccgctgatgatctgggtgtgcgcgcttccgtgccggcacttgctgcagcccttgatcagctggctgaggccggcgagccggtgactctgtcagctgcggtcaaggccgtggaagctcagcgggaagccgcaaaaacaacttcagaaacccgccccgttttccagaccttcaagggcggatacgcggagctgtacgaagcgttggcagagcaatgcggtgcagatattcacttggatagtttcgtttccgccatcaccaaagatggtgaaggttttgccatcaagggcggtggcgaaggcacctacgacaaggtgattttggcggttcccgctccaaccgccgctgtgctgctccgcgacttggcaccggccgcagcgccacatttgcgcgcaattaagttggcttcttcagcagtcgtcggcatgcgtttcgattccagcgagggcctgcccgacaactccggcgtcctggtcgctgttaatgagccgggcatcacggcgaaggccttcacgttctcctcaaagaagtggcctcacctggaggctcgcgggggcgcgctcgtgcgcgcgtcgttcggcaggctaggcgatgaggcgtcggcacgcatggacgaggatttgcttgtcgacgccgccctcgacgatctcctcaccataaccgggttcgacggccgggctgccggactgggtgaaattttcgtgcagcgctggttcggtgggctcccagcctatggagttgatcacattgctaccgtttcggctgcgcgtgcagagatcgcagccgtgcctggcgtggaagcaattggcgcgtgggctgggggagtgggagttcccgcagttatcgcagatgcccaggcagcagtacacaggttgctgggataagcacccaaaaacactattgaccaccccaatcgctgttgagagtttgtaaagttcgactgtcaacgagctggattggcttcacagattgaattaatacaatgacgcacatgacatcgtccaatacggctcgatccgcagagtggtttgaaaaggctcagaagctcacccctggtggtgtgaattctcctgttcgcgctttcggttcagttggcggacaagcccgtttcatcgaaaaagctcacggttcaacgctgatcgatgtggacggaaatgaatacgttgacctggtctgttcttggggccccatgctgatgggtcacgctcacccagcagtggtcgaggctgtgcagaaggccgtcgtggatggtctttctttcggcgctcccaccatcggtgaggttgagttggcccaagatatcgtcaagcgcacttctgtggaggaagtccgcctggtcaactccggcactgaggccaccatgtcggcggttcgtctggcgcgcggttacactcagcgttccaagattttgaagtttgagggctgctaccacggccacgtcgatgcgctgctcgcatctgctggttctggtgtcgcaactttcgctctgcctgattccccaggcatcaccggcgctcagacttctgacactattgttgttccttacaacgacattgaagccgtgcgcaacgcttttgcggagtacccaggcgagatcgcctgcatcatcgcagaggcagccggtggcaacatgggcaccgtcgctccaaaggacaactttaacgacaagcttctcgcgatcgctcacgctgacggcgcgctgctgatcctcgatgaagtcatgaccggcttccgcacctcttaccgtggctggttcggcgtagacaaggttgccgctgacctggtcaccttcggcaaggtcgtctccggcggcctacctgccgcagcgtttggcggcaaggctgaaatcatgaacatgctggccccacagggccccgtctaccaagcaggcacactgtccggcaacccggttgcggtcgcagctggtcgggcatcgcttaagcttgccgacgaatccctctacacaaccatcaacgccaacgcagatcgtctccacggtttgatctctgatgccttaacccacgaaggcgtagcccaccacattcagcgtgcctcaaacatgctgtctatccgttttgcagaaggtgagggccacaacttctctgatatgaaggcagccgacatcttccgcttcgcaccgttcttccacactttgctggacaacggcgtctacgcaccaccaagcgttttcgaaacctggtttgtgtcttccgctctcacggacgatgatttctccaagatcgagcaggcactcaagcccgccgcacgtgcagcagcagaagcgaaggcatcatgacgcaaaccattgtccatctagttcgccacggcgaagtccacaacccagagaaaatcctgtacggacgcatgcccggatacaggttgtcttcccgtggacgcagccaagccgcccgcactgcagcttcttttgaaggccacgatgtcacctacattgcggcctccccattgcagcgtgtgcaggaaacctccgaaccgttcatcaaggtcacaggcctagaactgatcaccgacgaggatcttctggaagcaggcaaccgtttcgaaggcctgcgcaccaaaggttggcgttcccagttgtggaaccccgtgcgttggcctttgatgtacaaccccacgcttcccagctggggcgaacactacaccgacattttggaaagaatgatggcggctgtggaacgagctcgggtggcagcggaaggacacgaagcaatcctggtgacccaccagttgccgatcgtgtgcgtgcaacgccacgcccgcggacaaagcctgtcccataacccagcgaccaggcaatgcgacctcgcctcagtgacatccttggtgttccaagacgatcaaattgtcggcgtgcattacaacgaaccagctcaggagatttgatcactcgtgcgtttgaccaaactagcagcaacaatcggctgcgtgacactcagcggacttgcgctagtagcctgcagcagtgacagtaccgctggtactgacgctgttgctgtcggcggaaccttccaattccactccccggatggaaagatggaaattttctacgacgaggctgaccgtcaacaactccccgacattggtggagattccctcatggaagagggcacacagatcaacctgtctgatttcgaaaaccaagttgtcatcctcaatgcgtgggggcagtggtgtgcaccgtgccgctccgaatccgatgatctccagattatccatgaggaactccaagctgccggaaacggcgacacccctggtggcaccgtgttgggtatcaatgtgcgtgattactcccgcgacatcgcccaagactttgtcaccgacaacggccttgattacccaagcatttacgatccaccatttatgacagcagcatccctcggtggtgttcccgcatcggtgatcccaaccaccatcgtgctggataaacagcaccgccccgcagcagtgttcttgcgcgaagtcacctccaaagatgtgttggatgttgcgttgccattggtagatgaggcctaaatgtctgagattgtggtagcccaaagcatcggccagcagtttgctgacgtcgcagcttccgggccactgttccttggcatccttgccgcagcgctcgcaggtctggtgtcttttgccagcccgtgtgttgtgccgttggtgccaggatatatttcctacctcgccggcgtggtcggtggggaagtggaatacagcgcgcagggcaccaaggtgaaaaccaagcgtttcgccgtgggtggcgcagccatgctgttcatcctgggattcaccgtggtgttcgtgctggctacggtcagtgtgtttggtgccatcagcgtgctcaccctaaacgccgacaccctcatgcgtatcggcggcgtggtgaccatcatcatgggtatcgtgttcatgggcttcattccaggcctgcagcgcgatacccgcatggcaccaaagcgttggaccacctggttgggtgcgccccttcttggcggagtgttcgctctcggttggaccccttgtttgggccccaccctggctgcgatcatctccatttctgcaggtactgaaggcatgaccgctgcgcgtggcgtgatcttaattgtgggttactgcctcggactggggctgccgttcctgctgatcgcgttgggctccagcaaggcactcaccggagtcgagtggttgcgcaagcattcccgcaccctgcaaattatcggcggtgtgtttttgatcttggtcggagtagcgttgctctctggctcatgggcaatttttatcaactgggtccgtcagtggaccgttgaatacggcgcaacactgctctagaaaaagacttttagtaggaagagaatcggcacgacaatgctcaaaacagtcaagctgtatgcacggaaagcgtggaactggctcaccagcatgcgcacagcactggcgttgctgtttcttctggcgatcgctgccatccctggcgcattgctcccgcagcgttccctcaatgaatcaaacgtcattgaatacattgagaacaatggaaagctcgctgagttctacgacaagattcagcttttcgacgtcttctcctccacgtggtttaccgccatctatgtgctgctcctgatctctttggtcggctgtattctccctcgaagctgggaacactacaaagccatgcgcgcacctgtggtgcgggcgccaaggaacctcgaacgtttggctcacaacggcgaggggctcgtcgaaaagcgtgaagaagaggtagaaaaagacgcccgtaaactcctcaaaggctggaaaatcaccgaatattccgccgaggaagaccgcgcgggagtgcgctccattgccgctgaaaagggctacacgcgcgaactcttcaacctgattttccacctgggcatcgtgggcatgattgtgaccgcaggcctgggacgactgttttactacgaaggccacgtcatcgtcgtgaccgacggcgagcaaaaccaacagaactccgtgttctgcaacactgccaccgccaactacgactccttccgcgccggcgccaacttcgacggcaccgggctgaccaccttctgctttgaagcgcacgatttctccgccgactacctcgccaacggccaggccgagatgttccgctcgaatatttcctacgcagtcggcgacgacatccaaaacgacccagaaacctgggaagactacgaacttcgcgtcaaccacccactgcgcatcgaaggcgaccgcgtctaccttcagggccacggcttcgccccaacattcaccgtgacctggccaaatggcgagacccgcacccagaccgtgcagtggcgcccagacgacccgaccttcttcctgtcctcaggcgtggtccgtttcgatccacccgccggcatgtacccagacctttacgagcgccgccaaaaccagttggccatccagggacttttcgcaccgaccgcggaatgggaaggcgacaacaacgaactgctgacctcctcctacccggcgatgcgtgacccagccgtggcgatcgatatttaccgcggcgacaatggcctcgataccggcatcggacagtcattgttcagcctggactctagtctcatgcacagcggcgtgctgcaaaaaattgagcgcgtcaacctccaaatcggcgacaccgtcaccctggatgatggcaccaccgtctccttcgacggcgcgtcagaatttgccaactaccagatcagccgcgaccccacacaaaactgggtgctggtcaccaccgtgatttcgctggtctccctggttggatccctgatgatccgacgccgccgcatttgggtgcgtttctatccacaagaaaacggaaccacccgcgtggaaaccggcggacttgcccgcaccgaccgcgcaggctggggtggcgaatacgagaaattccaccgcgaactgctgggtctgaaggaggaagatgaagacgaagagtacttcgaccacgacgactaacaccgcaatttaaaggcttttcaagcctgccccacatcgaagcagttttcacaaagaataaggttggaaaattatgttgcccgtcaaccaaacgtatgcgcagttctcagacactgccttcgtatcggcatacatcatctacgttctggcactcatcctctccctcgtctactacgtaaaacaacaaggcattatcgacgcccgccgcgagcaaacccgcgtcagcgaactcgttggtgcaggcggcagcgctgatgttgatactgacctgcctgatgacatcgccgacggtgtcctcgccgacgaagaccttgcaaaacgcgaagaaaccgcacgcaaactagccaacatgacccaatctctcatgtggctcggcgtcatggtgcacctcgtatccgtcgtgatgcgcgcgctgtctgccagccgattccccttcggcaacctgtatgaatacatcctcatggtcaccctcttcgccatgatcggagccgtactcatcctgcagcgcccacaattccgcgtggtatggccatggatcctcaccccaatgctggcactgctcttctacggtggcacccagctgtactccgacgcagcaccagtcgttccagcactgcagtccttctggttcccgatccacgtttcctccgtctccatcggcgcatccatcggtatcgtctccggtattgcatccctgctgtacctactgcgcatgtggcaaccaaagggtaaagaaaagggcttcttcggcgcagtagcaaaaccactcccatccggaaaaaccctggataacctggcatacaagaccgcgatctggactgtcccaatcttcggcctgggcatcatcttgggtgccatctgggcagaagcagcctggggtcgtttctggggatgggatcctaaggaaacagtctccttcatcacctgggttctctacgctggttacctccacgcacgtgcaactgctggttggcgcaacaccaacgctgcatggatcaacatcctggcgctggtcacgatgatttttaatctgttcttcatcaacatggtcgtatctggtctgcactcttacgccggactgaactaagcacttttggttggcggggttagtgagacccgccctcgttcttcattgagcgagggcgggtttgttgttttttgggggcgctcatggatttaggggcattgtgtgcttgcctagtcgattatttgtcatccctttggctttccatcagtccttgaagcagtcatagggggaatgtcttagtccacgaaagtacaggtacttcccggaatctcatttaaaggcgatctaagggggcgggtttttcgaatgggtgtgtgtctgggttgggtggggctaggcccttaaaagcgattctgggagggcaagtttttcgaggttggggtggcttttcgggtggcgtgtacgtattaaaccaaggagcttgtttgagggggagcgcttggtttgattcgacagttttcgggagttgaaagtgaagaattaggccagagggggctcgaaaatccgtctccttggttccaatcgcacgctttactctttctcgtgccccacattgtctttgactttcgttggatcgtggctttcacccgctcatacgtgcacgccatttagccaacggataggaagggtttttagggaggccctctctggcgatttaaggggtcgagtttttcgaggttggggtggcttttcgggtggcgtgtatgtattaaaccaaggagcttgtttgagggggagcgcttggtttgattcgacagttttcgggcattgagcctgacggaaggggagatcattcccatccaaacaaagctcggccactggcgtgacgtgcgggattccgaagatctgccattccaagtaatcgcatcgcgcaccagcgtgaccattatggaaaacaccctggaatggaccaacagccgccttgagcgtggcgaagagttcaccgagctcgacatttatgctcactacttggaagagttggaagattacgccctccaattcaccttcgatgtcgagccctacttcaccaacctgcactcctccaacagaatgctcttccctggacctcctgtggatttcccgatcaacgcagaaacccgatgcattcagctcgacgccggtgttgcagtaaagaaggacggcgtggtgctgggtacctcagatatggcgaggtccctgcctcgaaccgccgctggccaagaagcctatgagtacttcttcaaggtggttcgtgaaggcatcatcgggcagctgcgcccgggcgtgatctgcgctgacgtgcacgaagcaacccttgattacctaagcccgcagctacctcgcatgattgacatcggaatgctgggtgccgacaccgatttcaacaccatctaccgcaagcgcaatgttggccacctcatgggcaagcaggaatcctttgccaatgagcttcgccctggatacaagcacattcttcaccacggctcctatggtgccgcggagatcccttggcgctacaacggtgtagccattggtaccgaggatctgtggtacatcggcgcagacaagacctacattttgagccagcgctaaggagaacccagtgacagaaattgcagaaaaccttcagcgcttgggtattgaattacctgatctaccagcaccgcagtattcctacgtaccgttcaaccgccaaggaaacaccctctatgtatcggggcagatttcacgaaccgcagcgggagacatcctcgccggacgagttggcgaagacgcaacattagaagaaggaatccacgccgcagaggtagccaccatcaatctgctggccagaatccaccaatccatcggtttagacaatgtggcccaaattctgaaactgaatgtgtgggtcaatagctccgatgactttattcagcagcctcaagtggccgacggtgcatcccagctccttgaggcagtgttgggtgaggccggaaaacatgcacgcacagcactacccacaaatactctcccccagggagcactagtggaattggatgctgtcgttgcggtcaccgaggccgccgaagtttaggacgcgtgggcgaaaatttcagcaaccgtatcaatatgagcggaattaatgctgaaatacgcccactttccgcattgttcacggttgaccaaattagctgcgatgagctttttcatatggtgggtcaccgtgggggcggaaatattgagtgtgtgtgccagggcattcgcgctcacccgcgagctttttgtagtgaaaatcaggtacaagatttctaggcgggtggtgtcaccgagtgccttgtagaaatcgctggcctcttcggcgatgtccgtgatcctgctgggtacggattttagcggcgcgaagcgctgctctgtggcactgtctgcgctggatgggataacggaggtcattcactcaatatataggtatggcaagcctaagtgaattgattgagtgaattgaatgcatcacacccgattacaggggtattgaaaatctttttaaagaagcccttttaagaatcctcagtgggcttctctggaccttcttctgagctttcaggctttgcgtagcgttccctggcccgtttgagacgttcttcctcttctaattgggcagcctcgtcggcgcgacgctgtttgaagcgattcttttcaatattccacaagaattcttcatcatcgtcggggcctttcactgcacgaggtgcctggccctgattgatctccgcgttacgcttccatgtagatggcttgaaggccttccacagcaagacgattgcgacgataaccaaaataatcagcaaaagcctacccacttgaacctctccttaaatatttgcttcaacctcccacaatacggaactttgaggcattcttgggtatcggtatgtattgagtagggttgaatatgtgagtgagtccaatacccccaatctccagacacaccaagcgccggaattaaacccggaactacaaaaagctgcccggaaaaacgtgctgatttacggtctggcacgtttgcttctgttcgtcgtgctgaccttgattattcatagcctggctctgctgattagtgcgcctgtgccactcgttatgtctgcgatgctggctctgattgtggcgttcccattgtccatgctggtgttcagcaaactgcgcatgaatgccacccaggctgtttcccagtgggatgcacagcgcaaggcccacaaggaatgggttcgaagcgagctggcggaccgctaaaaaattcccctcgttctttgcggaagcgagaggaaaggggaggggagcgtcgaaaagcgttttagctaaacgctaatgccaggcccgtgagcacggcccacaacgccatggcgcgccctgttgagccgatgacggggatgagatccttgccggtggcgttgttgcggatcggccctgcggctttcagtgccagcgggaaaacgatgatcgcgatcagcgctggccaggcgacaaacgccaggcagatggacatgatgaacggcgtggaaatcagcgcgaggaacagcttacgagcacccgcatcgcccaggcggaccgcgagggtaatttttccggtcttgctatcggttggaatatcgcgaatattgttggccaagttcacgccagcagacatcgaccccacgccaactgcggcggccaaaccggcccagctgacggaaccggtttgggtgaactgcgttcccatgaccgcgacgaggccgaagaagatgaacacagcaatctcgccgagcccgcggtaaccataaggatttttaccgccggtgtagaaccacgcgcccagcacacacaggatgccgatgaggatcagccaccacgcgctcaacaggctcagcgcggtgccggcgacacctgcgataccgaaagaaataaacgccgcagctttcactttcttcggctcagccaacccagaaccagtgagtcgcagaggaccggtgcggtcttcatcggtgccacgaatgccatcagagtaatcattggcgtaattcacaccgatgatcaaagcccacgccacgacaagcgccagcaaggccttccaccacacaaaaccatcatgaaaagcggcgacacctgaaccggcaatgacaggcgcgaacgcatttgcccaggtacgcgggcgtgcgccttgaatccaatcggacaaagttacagaattcggctggggttccgtgtgagacataacctctatctttccccatcacatactcgatcgcgcaattgcttgaaatacgttcggcaggctatgggggagtgtgaaacgctattgtgaaatgaatagataggttccatagtcgatcgaggaggagtcgcagaagtttatgtgggttggttatgcggttcgacagatcgccagtgtttttcttactcttttgcgcatgctgccactagcagcgcgaaatcgagttgccaggggacgcatcccggaaaccggcgatgtggtgatctcattgaccacccatgggaagcgaattaactacgttcacttcaccatcgaatcgatcgcacgcggccatgtgaaagcaccaattgtgctgtggttggacaaaccagactttgatgcgccgtggcctgccaccattaagcgacttgtcgcccgcggtctgcaagtacggtgcagcgacggcttctacggcccccacaccaaatactggaaccaattccgagaaatccacggcaccggcgtgcgtgtcgccaccgtcgacgatgacatgatctaccccgagtggttcctgcagcgcttgctttttattggcgacctgcgcatggatgcggttgtcgcctaccgggcgcacagaattgagcttcgcgacgaccgaatgctcccgtacgttaaatggagtgccgcagacacctcaaaagcgtcattcctgcactttgccacgggagtgtcaggcgttttgtaccccgtgaccttcattgattatgtggtctcccagggcgatgtattccttgagaactgcaagcgcgccgatgacgtatggctgcatgcctgcgcactgcgctctgatcaccctattcgccaggtctacgctcagccccgacacttcgctgtcgtgcccaccacccaagtgggagcactagttgttggcaacaccctcatgggtggaaatgatgagcagatcgccaaagtgtacaccgatgaagatgtggcaaaactagttgcagccagcaagaatgaagactaaaacagcttcgcgatagcacgtcgatcagcttttccaggaccaatgctgggcaaagattccagatgcttcagccgtttgggaagctgccaacgaggtagatcgtcgaggccttcaataacttcagacggactgatcgatccggagtacgcggccacaattgcttggcctaatcggggatcgggaatacccacaacacacgccgcggtgacacctttaatatctgcgatggcacgttccagtacctctgggtgcaacttcaatccaccggaatcaatgacggtatccacgcgaccagtcacggtgagaatcccgtcgtggagttcacctgaatcagaggtggtaaaccaaccctcgttggcgaaatccggatgttcaggtgcatttctgtagccctgcgcaatcatcgggccacccaactcaatgcgctcatccgaaatacggactttcgcgccgggaatgggcttgccatcataaacgcagccacctgaagtctctgaggagccgtaggtggtgacaatgttgatgtctagctgctccgcagaaattcgggcctgcttagacaatgcagcaccgccaacaagaatgacatcaaaaagtttcagggcttcaatgccttgcaaggagtccattgctttaagtaactgcattggagtcaaggatgtatagacgcggtcgccggtatttttcagttctgccgcggcgcctgcgaaagcgtcaatgtgaaaacctgtgctgagatcaatagctagtggctcaactccagcaatgaggcttcgaagaagcacctgcatgcctgcaatgtggtgtgctggcatggcaagcaaccactggccttcgccacctaaaaactgatgcgtagcatcggcggaactcaccaaattcaacggagtgagctgagcgcccttcggggtacctgtagaaccagaagtggccatcaccaaagcgatcgaaggatcgatggcgaggccaactcgttgagaatcgcgcagcaactgtgcacgggttttatcttgtacagggatggggaggaaagttttcttcccagagattgcgtcctcgagatctcccagaattgcggtgggatctgcaagatcaacaggtagtgcttcgaggacgcgagtattcatattccgagattctagtgccgatggttcagaattcggagttgtggcgctagatttaggccttgcgttttgccagaaccccgtcgatgctccatgcacctgcgccaactgcgatgagaagcagcgcgccagcgccgattgcgccggtgagttcccaaccattgttggtgacaaagatgccggaggagacgtgcgcaaacagtgctgcgaagagcatgtctatggcaacgaaggcggcaacgatgcgggtaaatactcctaggatgataaggattcctcctaggagctcgacgactgcagcagctattgcggcgatgccggctgctgggatgccgagtgaatcgaagaagccggtgacgccttcaagtcctgtgatggcgaacttgtcccagccgtgggcgatgaggatgacgcccaagaggatacgtgcgatgaggaatgcaatttccctggtagttgacatggtcactaaagctagaatgaattagtttccgtgtcaactattggggtttcgtcggagctttctggcaaatgtaaagaccagctattaacggtctatttcccgaggtacagcccatttattcgcctcagaaactggatctggaagcagctcagccgggaaagtttgataagaaaccgggcgcataaatctctcgattgccagggttccaacacttgtcgactgcgcatttgaggtcgccggataagggcctccatggataaccgtgtgcccaacttccacacccgttggccagccgccgtaaagaacacggcccgcgagatcctccaagagggggataagtttcgagacttcctggaaatcatcctgggatgcgtggatcgtggctgttaattgtccctcgagtgaattggctacttggtggagttgatccggggaatcataacgcaccaccagcgatgccgcaccgaagatttcttcctgcaacaccacattatttagcaacgcctgcacatcactttcaaacaccaccgggcccggcgcgttctctccatctccgggggtgccttgggcgaggatttttacacttggctgtgctgcaaggttgtcgactccgcgctgccatgcctgagcgatgccttgcgtgagcatcgtttgacccgtggtttctttaaatttggctgctacgagcgccacaaaagcatcaccaacaacaccgcgcgggatgaaaacgaggccaggcttggtgcacaattgcccggaactgccggtgacggaagcggtaaacgcctcagccaaggaactcgatgcatccaaatccgccagcgcgccggggaagacgaacacagggttggtggcactcatttctgcaaagactggaacgggaactgggcggctaaacgcagtctgtgacagtgccaaaccaccctggcgtgaaccggtaaaaccgattgccgtgatattcggatccgcagccagctcctggccaatttccacgccacggccgtagacaaggttaaacacaccagcatcaaactcatgcttttcgacggctccccgcaccgcttgcccgacgagctcagctgttccagggtgcgcattatgcgccttaaaaaccacagggcagcctgcagccaacgctgatgctgtatcgccaccagcagtagagaaagcgacggggaagttgcttgccccgaataccgcgactggtcccaacggaacctgacgctggcgaagatcaatccgcggtcctcgttcaatgcgtactcggtggaactgtccgcttctcacggtttctgcaaacaggcggagctggttgctggtgcgggctacttcgcctgtgagtcgggtagttcccaaacctgtctccaggctcgcccgttgcacgatctcgccggatagcgcatcgatgttgtcagcgatggaatccaggaaatctgctctaacctctggagtagtgagtcggtagctttcaaaagctcgcttcgccgatgttgtggcggcgcgcagctgtgcgctgtttgctaaagagtaggaagggttcagactcgcattggtgcgcggatcgaatcctgtaatctcaccattttttccagcgacccactcgccatcaatcagtgaacacccatgcagtgcggttgcggtgatcatgctttcacctcaactggaaggcggtaggaacctgcgccagaggtggcaagcaaatccgacaggtccgcgatatcttgctcggaaaggttacgcagtggtgggcgaacgccgccagcgttgcggccaacagccttgagtccgcccttaacaatggagacaccgtagccttgtgcgcgatcgcggatatccaagtaggggagcacaaaatcgctcagcttctgctttactgctgcgctgtcctgcgcacgaacatcggcgtagaagctcagtgcgaaatctggaatgaagttgaacattgcagaggagtaggtgctcatgcccatctgaagcagtggtagtgcaaaggtctcagcggtgggaagtccaccgaggtagaacaggcgatctccgcatagcgtggtgatctttgctaggtgctcgatgtttccggtgccatctttaaatccaatgaagttggggtagcgctcagagagtcgagcgataacctctggggagtagatggcattggcacggttgtacacgatgacaccaagagaagtggattcacagactgcggctgcatggttgtacaggccttctgcgtcgcattcggtgaggtagggaggaagcaggaggacaccttcagcgcctgctgcctctgcgccctgtgcgtttgcgatggcagacttagttgagccagtagcagaccccaacacgggaacttccgggctggacgcctgaactgcaagttgagtgacacggtggttttcctcaacggtaaggctgaatccttcgccagtaccgccagctgcgaagaggccggcgactgggtagctggactgccattcaatgtgctcgacataagcagcttcatctacttcgaggtcatcttggaaagcggtggccgggaaagagagcagtccatccttgaggtggtctgcgagatcttgtggtgaaaagcgtgccatgagggctccttgggtgagtgttttctaagacactttggagtctaagaggagccagtgatacctgtccaagattagtttggcatgttgaaatgcttaaaaggtatcgtcaatgtttttgatgaatttccgcaccgcaggattatcattcgaggtggaataaatagcctgcagctccgctaaaccaacaggtagatcataaaaatggcgatactcaacaccgctgtaattgagttttttcgcagactccggaaccagcgcaacacccagtccagaggccaccagactaaccatcgtggtgatctggctcagcgtatgttgcacctgcgcatcattgatcgtgaagtttctaacaacgatgtcgtagaggtacttcgccttggtgggagagtgctgcagaaaaggaaccccagtcagatgcttccgcaacagtggtcgattctgatcaagaagtggatgccccttcggagctgcaagaaccaaggaatctgcctggagacgtcgagtttgaagaccctcaactggcgagctcaatcggccaatgccaagatccagtagcccagattccaaggcggcgatctgctcggtggagaccatctcaaaaagatcgacactgacccccggcatcttctcatgcaactgattcaacgtcgggcccagaatggaaaaacccgctgcagcggtgtatccaatattgagctgtccccacatgccagagctagccaatcgtgcgcgctcagccgccttctcggtggaattgagaatgaggcgagcatccttcaaaaatgcgaaacccgcagtggtcagttccaccttgcggttgtcacgatcaagcagggttgcaccgacgatcttctccagcttttgaatctgacgactcaacggcggctgcgtcatggatagctctgcagcagcttttccgaaatgaagatgattggcgacggcgacaaaacaccgcaactgttcaagagtgaacaacaaaactccaattaattaattgcgggtggggaagccctcagcctgcagctttttctgaattcgatcgatgtcttcatcctcaggtggctgactgtgaacatgcgtgatcagcttgccgattttttcacgcgtaatgggattatcgtgcagcccattgttctcaccttccgcgatgagaagctctgcgagctcattgagatcttcctcagtaagttcgcgctccaaaacgtaaaacagagcgaaagtatcgtgccgcggaacaccggttggataaccttggcggagccaattgagcgctcggcgagcaaagtttgggctgtcgttgtggctcatgatttaagtttaggcctgtgggaaaagaaaatcattgaatttcactattgattaatccgtgggctttggggttactacaactcacgacatagcaatgtccctcccgcttaacttaaaagcgggagagacatttcgggtcttaaaactactggtctccgaggtagaacgctgcagcgttgttccagaagacgttgtcgacatgatcttcgccaaccgtttcagcgatcaaatctaggtcagcgtcttcgaaaggtcgcttagtgcgggtggatggaagatcagttccgatcatcaaagcagtgggatcgacagccatgattgcctggatgacttcagttggatctagttctacccgtccgaatccggttgctttgactttaatgccattttctaccaagcgaagaagtgcgggaagtccatcgcggtggagccctaagtgatcaatgctgacagcagggagggaggccaaggttgattccaactcgtctagttcgcgagcatccacatagagttcggtgtgccaaccggctaggtcgtggactcggcgtgccaaggtctcgagatcgtcaagacctgccgaaccaccgcgcttcaagtttaaacgcacagccttcacgccagctttgtccagatcaagaatctcctgatcagaggtatctgcggggatctgagtgacaccgacatagcctgggccaagcactgcgagagcatctttgaggtagccctggtcgaaagcctggaaagaaccggaaacaatcgctccgccagcaacttcgaggccttcaacacgcgcagtgtaatcctccacggtgaaaggctcggggaggtagccgttgttttcgatcagtgggtgctggggatcgatgatatggaaatgggaatcaaacaacttggccatgatttagttttccttaggtgcttcaggcagacgggagacaaacttctcacggttaaccacaccgcgctggtgggtgccggtgctgatggtggcgaactcatcagctgcagtgatgttgaaggtaactgcacgacggttgatctctgtcacctcaacatcgatggtgaccgtggatccaggaaccgttggagctgcgtgggagaagttcacatgagtgcccagcgagatttcaccgtcgtccaaatggggacgcagaagttccatgcaggcccactcgatgatgccgaccatatatccagtggccaggacatctggcatggtttcaaattctgctgcttcgggaagcagatgcggaactgtgcggtttgctggcactatgtaggtcatttggtgggttaaaccggtggtcagtgtctctttcatgaggactctcctgaagcgttgcgtcggatgttaataatttctgttgctgtttgttttgcgtccacgatgccagtgatctcgccggtggtgatggcacggacgctggcgccgtcgataagcaatgaaaagaatgacccgcactttgctgggttcgccaggccatcttgagcggaaagctcggtgagcgtgtggcgaatccaggtattcggtgatgtcccattttctggtatcactacggcgttaaagaactgcggcgaccaggccggattcagccacgacccggtcgactcagatcgcgcagagtccttcggcgtagaacagccgagtggcttcggagaggattttctctccgcttgtcgagtacacgccatcaccataacttacaggtcagtaaagcatcttgcttttggaaaaacttctcatataggtctctggaatgacaaaaaccaggcccctttgaagagacctggtttggagaaagttgttattcgcagctggtgcttttagccttcagtgccgaaaatgtcgaaaccagagtactggtagatcgttgctttggtgacccagagaatgccagcgatgatagcaaccgcaatgatggcaaagcagatggttgaagcaatttttccaagagcgttggtgccgttggaagaagggctgtgagcaaagcggattcctaatgcaaaaagggctggaaggcctgcgccgagcaaaatgcccacgagggtgacctcaaagatgcttccgaaaatagtagcgaagttcattacttggttacctcattctcgttgttgagatcttgaacggcttgagcggctggagcggcaggagcttctgtaatctcagaagcagccggggcggaaggtgttgcaggttccacgctgtttgattcttcattccagtcagcgttgacgttgcttggatcaacaggcacgcgacgggaacgggcgtaaatgtagccagacagaatgaccagaatggcgaatgcaacgaggactccgaggaggtctgagctgataagaccaattccgtgagctacccaccagcagaaaacgccaacgatcgcggaggcagggagggtgataacccaggccattgccatgcgtcctgcgacggaccaacgaaccttcgcccctttacgtccaatgccggtacccatgatggagccagtagcaacgtgagtggtggacagtgccataccgaagtgggaagaagtcaaaatgattgctgcagaagaagtttctgctgccatgccctgaggggaatcaatctcaaccaagcctttgcccagtgtgcggataacgcgccaaccacccaagtaggtaccgattgcgattgccaatgcacatgtagccttgacccagaatgggatgtcagcgtcagttcccaggtgaccggtggcaaccagggaaaggaagataacgcccatggtcttctgggcatcgttggtgccgtgtgccagggaaaccaaggaagcggagccgatctgaccccagcggaagtaacggttcttctcgttgtctccaactgcctttgtgatgctgtacacggcgaaagtgccgatggcggccacgagacctgcaacaactggtgcagccaatgctgggatgatcatcttggacaagacaccttcccacaccactccgccgaaaccgagtgaagcaattgcggcgccaatgaggccaccgaaaagtgcgtgagaggagctggaaggaatgcctagcagccaggtcagaaggttccagacgatggcgccaatgaggccggcgaagacgacaagcaggagctggtgggaatcccaggcattgcttaggtcgaattggtcgaggtcaacaacgcctttggcaacagttgtcgcaacttctacagagaggaatgcgccaacaaggttcagtgaggcggatagtgccacggcgactttaggttttagagcgcctgtggcaatggatgtggccatcgcattgccggtgtcgtggaatccgtttgtgaaatcgaaggcgagcgccgtcacgataacaatcaataaaataatcagctcggtcacgattgggaagtatgccctaaaaagcgtagaaaccaaatgtcgattttggattttctgacggtaaatgcccaggatagagttcgaattccccatgattggggtgaccatttgtattggggctatagctattattggtttgcaccaactagcaacatggggttttaggtcagtttcgagaccaaattcgttaaattacttaagaaagtaaaaaccttaaatcaaggaaccaacaagatgaacagtgagtgaattcttttgatcttgctgatattaacgagtttcgggggtggaaagttcctgaatttcagaaactacatgtgcgtacttttggagtgccgaagttttcccctcaccgtgtgtcaatggagatgagctgagcgtgacaagggagtttgttgctggcaattaagattctcatcctgatttcagctaaagcttcacggaaaatgtttttaacttcatttacggtgtgcacagatcagcttttgaaggcgaatggtagttggtatagcaccaatggcgattccgcattcatatggataactcgatgtccgaataaaagggattgagcggtgcacccatgagggggatcgtgatagcatgaaagcattgcctcctgttacgacagtgaaggaagaagaccctaggaccccagccggacgactggacctagggtcttcgctttgttttattctcatagtgattccggggttaatgaattgagaacaactctgtcttgcaattgtttccagtagagatcatttccaagatagttagagttaatttctcctaagaaaatatctggaatccagagtaaaggttcatctccgccccggatgtgtactatacgaatctttgaggcttgtccacgcccttgtagtgcgacgatatgttcgatgtcctttttattttgagccacttgtcgactttccaggacgacctattggactcccatgttggatagctcaaaatacatattttcgaggcatttccttcggtagcgttctgtctttacttatctcgctgcgatgagtaactacagcttgcatggaatcaagggtggataatgtcttgactatcgttctgcgacgactctcacgctcgtctgtccaatgcagcttaatctgacctggaaggcgtaacggtatgagttcagtgcgtatcgcgtccgagttgacagaatcaataatagccgcgcacaccatgtaatcttggcggttttgggatcgcatggctgatgattcgtctatataggcaactagctgcgattccacatgttaaagcgtaacctgttctggtttttcttccggcggtctcgttgtaaaaaaggaaagcaagcctccccctctcaaagtgaggcggaggctgggcatgaaaaacaattaagacagccgagctcgtacccggtaagtgttttaggaccccatgaactcactagtagtagtaagggaattcattccagttgggttcgcgcttttctaggaatgcttccttaccctctacggcttcatccgtcatgtaggccaggcgggtggcttcgccggcgaagacttgttgtcccatgaggccatcgtcggtgagattgaaggcgaatttcagcatgcgttgcgcggtgggggatttggtgttgatttcgcgggctgcttggatggcttctttttctaggtcgccgtggtcggccacgatgttgactgcgcccatttgttgcatgcgttcggcgtcgtaggtgcgtccgaggaagaagatttcgcgggcgtttttctgtccgaccattttcgctaggtaggcggagccgtagccagcgtcgaaggatcccacgtcagcgtcggtttgcttgaagcgtgcttcttggcgggaagcgatggtgaggtcgcaaacgacatggagggagtgcccaccgccggctgcccagccgttgactactgcgatgacaactttaggcatggtgcggatgaggcgttggacttccaaaatgtggaggcgtccgccttcaactttggtgcgggcaatatctaccgtggagacatcagcggtggcatcgtcgcgcgcgtgttcggtggcgtattggtagccggagcggccgcggatgcgttggtcgccgccggagcagaacgcccagccaccgtctttttcgctggggccgttgccggtgagcaggatggttccaacatctggggtgcggcgcgcgtggtcgagggcttggtaaagctcgtcgacggtgtgggggcggaaagcattgcgaacttcggggcggtcgaaggcgatgcgcacgatgccatcggcgcgggtggtgcccacgtggcggtggtaggtgatgtcggtgaattcttcaaaacctggaacggtggcccattgggtgggatcaaaagggttgtcggtgctgtagttgctcataatctttaaccttaagcctctgccgaaatggccaaggtcttggcgtgggcgtcgatgacttttgctagggcgacatcacggtcggttatctcacccacatcgtggctggtgagggtgatttccacaaaaccataggtgagaaggatatcggggtggtggttggcttcttctgcggagtcggcaatgaggttgacaaatttcatgccagtggagaattttccggtgttgaaatgtgcggtgagcttggcgttggcggaggaccagtgtggggagacgtcgaaaagcgaattcatggccccatcttgccttaaaatggcgcacatgcgcttactgctgacctcctttggccatgatcatattcgggattttgtacgcggtaccgtggcgtatatccctgatgcgaccaggctttttgctgatagtcccgaggctgctccttttatggagacggagcgaaatatgctgcgcgagcacggcttgagcattcgtgagctgccgatttccacgtcgactccggaggaagtggatcgggtgcttggtgaggttgatggggtgtatgtggcgggcggtgagacttttgatctgatgtggctgctgcgttccacaggcaatgatgaggtgttgattaagcatgttcgcgctggtctaccgtatattggaacgagcgccggcgcggtaattgcaggtccttcgattgaaccgatcagctttttggatagccccgatgtcgcgccgaatttaagcgactattcaggtctaggcctgtgcgagcatgtcgtggtgccccatgctggtggcacgatcccgcaatttcccatcgatgtgtttgcggaaaccgtgcgcacctacggcgccgaattcccgctggtcctgcttaaagatggacaggcactgcttatcgacgaccacggcgtccacctaatttaggatggttccccatgagcaccccaactgttgatgagattctagagcgcgcccacgtggtgtcgctgccgatgcgtgtgaagtttcgtggcgtcaccaccagggaggctttgctgattgaaggccctgctggttggggagagttcgcgcccttccttgagtatgacccgcaagaatcggccagttggctaaagtccggcattgaagcagcgtgggagggttttccggcgccgttgcgtgatcgcgtggaagtcaatgccaccatcccagctgttccggccgatcaagtggcagaagttttggaccgtttcccaggctgtcgcaccatcaaagtaaaggtcgcggaaccaggccagaccttggctgatgacatcgcgcgagttgccgctgcccgtgaggcacgccccggcgcgatcatccgtgttgatgccaattgtgggtggagtgtggagcaggcggtggaggcggctcaggcgttggcgccgttggattatttagagcagccgtgtgccaccgtggaggaactggcggaagtgcgcatgacggtgcagcggcgcggactttttgtgcgcgttgcagcggatgaatcgatcagaaaatctgatgatccttatcgggtggcggatctgcgtgctgcggatgtggctgtggtgaaggttgctcctttgggtggtgtgaaaagggtacttgaggtggtgcaacatttgcgggcgcgcacgatggacatcactgtagcaagtgcgttggacacggttgtggggatgaatgctgggttggctgcggtggcggcgttgccgaagttggatgatgacgatctcattgatgtgccaccagcggcggcgggtcttgcgacttcgcagttgttcctggaggatgtcgcgaccccgcacgcaatcactgatgggttcatggaaacgcgtgtaattgccccggaaatggatcgtttggaaacgcttgctgccagcaaagataggcgtgattggtggtttgagcgcgtgcgtgaatcgtatccgtacctggagacgatctagactgttgtgcatgtccagcacgccagctcaagatcttgcccgcgccgttattgattccctcgcaccacacgtcactgacgtggtgttatgcccaggatccaggaactcaccgttgtcgcttgagttgctggcgcggcaggatctgcgtgtccatgtgcgtatcgacgagcgcagcgcctcatttttggcgctgtccctagcgcgtacccaggcccggccggtggctgtggtgatgacctccggcacggctgtagctaactgcctgcctgctgttgctgaagctgcgcatgcccatatcccgttgattgtgctctctgctgaccgtcctgcacatttggtgggaacgggggcgagccaaacgattaaccagaccggtatttttggtgatcttgcaccgacggtcggtatcactgagctggatcaggtagcgcagattgctgaaagccttgctcagggggcttcccagattccgcgtcatttcaatcttgcacttgatgttcctttggttgctcctgaactgccagagcttcatggtgaggcagttggagcatcatggacgcatcgctggatcaaccacggtgaggtgaccgtggacctgggggagcacaccctcgtgattgccggtgatgaagcatgggaagtggaagggctggaagatgtgcccaccatcgctgaacctactgcaccaaagccttataatccggtgcacccactggctgctgaaatcttgctgaaggagcaggtctccgcggaaggctatgtggtaaacaccaggcctgatcatgtgatcgtggtgggacaccccacgctgcaccgcggagtgttgaagttgatgtcagatcctggcattaaattaactgtgctttcacgcaccgatatcatcactgatcccggccgccatgccgatcaggtgggcagcacagtgaaagtcaccggcacccaggaaaagcagtggctaaagatctgttcggcagcatcagaacttgcggccgatggtgtgcgtgacgtcctggacaaccaagaattcggtttcaccggcctccatgttgccgcagccgtggcggataccttaggcaccggcgatactctctttgctgcagcatccaactcaatccgtgacctctccctggtgggtatgccttttgatggcgtggataccttctccccacgaggtgtcgcaggcattgatggttctgttgctcaagcaatcggcacttcacttgctgtgcagtcccgccaccccgatgaaatccgcgcgccacgcactgtggcccttctgggcgatctgtcgttccttcacgatattggcggactgctcatcggccctgatgaaccacgcccagaaaacctcaccatcgtggtctccaacgacaacggtggcggaatcttcgaactcctagaaaccggcgcagatggtctccgccccaacttcgagcgtgctttcggtaccccacacgacgcgtccatcgcggatctctgcgcaggctacggcattgaacaccaagtggtagacaacctccaagacctcatcatcgcgctagttgataccaccgaagtatccggattcaccattattgaagcttcgaccgtccgagatacccgccgtgcacaacagcaagctctcatggacacggtgcactaaatggagtggtaccaagtgcgccgacgggcccgacaactgctcattgtcctttttatagcagcgatgctcggagcagcctccatggtgatcgggccattccttaacgaccgcactatcgaaggcaactccgggcgcgccttggcacaagtaaccaacgtcggcagctaccgcacaacggtggatttccaagatgaaaacggcatctatcactcaccagccaccggcctgttgttccccacgggactgggcgaggggcaacgcgtgtgggtgaactacgccaaatcagatccagacctggtcaaagtagaaggccgcaagtggacactgtccatcatcccagcgcttagtgtcgcagctgtcgccaccgctacctggtcagtactatggctgggagtgggcagattcggaagacgatccgacgacgccaacgaaaccacagtgtaaagctctatgccgggagcattcaccaggatgtaaccgaaaagatctcaacacttaaataaagttctcgataaagccatgttcggttaactgcgatgtaggcatgatgtggagataataaggcccatgcgggtagcaattgttgcagagtcgttccttccaaatgtcaacggagtcaccaactcggtgctccgggtgttggagcatttgaaagccaacggacacgacgcgctcgtcatcgcgccgggtgcccgggattttgaagaagaaatcggccactacctgggctttgaaattgtgcgcgtccccaccgttcgggtcccactgattgattcactgcccatcggtgttcctctgccctcagttacctctgtgctgcgcgagtacaacccagacatcattcacctggcatccccatttgtgctcggtggagcggcagcattcgcagcaaggcagctgcgcatcccagcaattgctatctatcaaactgatgtcgcagggttctcccagcgctaccacctggcaccgttggccactgcaagctgggaatggatcaagacggtccacaacatgtgccagcgcacccttgctccctcatccatgagcattgacgagctgcgtgaccacggaattaatgatattttccactgggctcggggcgtggactccaagcgtttccaccctggaaagcgttccgtagcgctacgtaagtcttgggatccaagtggagcaaagaagatcgttggtttcgttgggcgccttgcatccgaaaagggcgtggagtgccttgctggattatccggacgctcagacatccaattggtcatcgtcggtgatggcccagaggccaagtacctgcaggaaatgatgccggatgcgatcttcacaggagctctcggcggcgaggaactagccaccacctacgcatcactcgatctgtttgtgcacccaggtgagtttgaaaccttctgccaggcgatccaggaagcccaagcatcaggtgtgcccaccattggcccacgcgcaggtggtcccattgatttgatcaacgaaggcgtcaacggcctgcttcttgatgttgtagatttcaaggaaaccctccccgctgcagccgaatggattttggacgattcccgccactccgaaatgtgcgcagctgcttgggaaggtgtgaaagacaagacctgggaagctttgtgcacccagcttctccagcactacgcggatgtaatcgcattgtcacagcgcatcccactgacattctttggccctagcgctgaagtagcaaagcttccactgtgggttgctcgcgcgctgggtgttcgcacccgcatcagcatcgaggcttaactctgcagaattaatccatgggagtaggattagcgcccattaacgcttcacatccttatattcccaaggagcacgaccatttctgattcagcagtccaggagaatcacgaaccgcacctcaagcgcggtttgagcaatagacaccttcagctcatcgccatcggcggagcgatcggtacgggtctgttcatggggtccggcaagacgatctccgttgcggggccatcagtaattttggtgtacgccattattggtttcatgcttttcttcgtcatgcgtgccatgggagagctgctgctcgccaatttgaattacaaatctttgcgcgatgcggtctctgatattttgggtcctggcgcaggttttgtcaccggctggacatattggttctgctggattgccacaggcatggcggacatcgtggcgatcactggatacacccaatactggtggcctgagatcccattgtggcttccaggtgtgctcaccattgcgttgctgtttgccctgaacttggctgcggtacgactgttcggtgagatggagttttggttcgccatcatcaaaatcgtggctatcgtgtccttgatcgtcgtgggacttttcatggtggtcacagcctttgaatcacctaatggcaccaccgcgcagttcaacaacctcattgagcatggcggatttttccccaacggcatcaccggtttcttggctggtttccagatcgctatctttgcgttcgtcgggattgaacttgccggcactgcagctgcagagactgagaatcccaccaagacgcttcctcgggcaatcaactccattcccatccgcatcgtggtgttctatgttttggcgttggctgtcatcatgatggtcaccccatgggatcaggtccgtgctgacaacagcccattcgtgcagatgttcgcgctggcaggaatcccagcggcggcaggcatcattaactttgtggtcatcacttctgcagcgtcgtctgccaacagtggtattttctccacctcccgcatgttgtatggattgtctttggaaggcgcagctccgaaacggtggagccggttgtccaagaacttggtgccagccaggggattgactttttctgtgatttgcctcattccagcggtgggtttgctgtacgctggcggcactgtcatcgaggcattcacactgatcaccacggtttcttcggtgttgttcatggtggtgtggtcctacattttggtggcttatatcgtctaccgccgcaacagcccggaattacacaaaaagtcgattttcaaaatgcctggcggcgtggtcatggcagttgtggtgttggtgttcttcgcagcgatgttggtggtgctgtccctggagccggatacccgtgcagcgctcatcgcgacgccagtgtggttcatcattttgggtatcggttggttgtccatcggtggagctaagggcgctaagcatcgcagccaaataacctcccactaaagctcctgggttagactcgaacgcgtggctaaagcagatttagacaaggaccccttcgacgtagcgtcaatgttcgatgacgtcggaaagaactacgatctcaccaataccgtgctttcttttggtcaggaccgtgtgtggcgaaagcgcactaggcagcgcctggacctcaagccaggggagaaggtgcttgatctagctgcaggaacagccgtttccaccgtggagttggcaaaatccggcgcgttttgtgtggcgtgtgatttctcccagggcatgctcgccgcaggtaaagaccgcgatgtgtccaaggttgtgggcgatggcatgcagttgccgtttgcagacaacagctttgatgctgtgaccatttcttatggtctgcgcaatattcacgatttccgcgctggcctgaaagaaatggcccgcgtgactaaacctggtggacgcctcaccgtggcggagttctccacccccgtgatccctgtgttcggcaccgtgtacaaggagtacctcatgcgcctgctgccccaggcggcgcgcgcagtatcgtccaacccggaggcctacatttacctggctgattccatccgcgcatggcctagccaggcggaactagcacgggagatcaaccagaatggttggtcagattgcggttggcagaacctgaccttcggcatcgtcgcgctgcactcggcgattaaaccagagaactagtcgagtcccacagaggggagcccttccgcgcccaactaatcgcggatccggcggcctgccaacccctggcgagcaggtctttatcctcctctgtgatcaggttgcccatcaaacgcgcagccgccggcatgatggccttttgcagcggcccgcggaatgcgagcggcccagccatcggcaaaaactgcgggtacgtcagcagtcgagcagccgtgcgcgccaacatgaaggtctcgccgtacgcgtcgcgcaacctatgtggccataccaaggtcaaatcgcgcttggggttttccacaagcgtgtcgacggccatcgccgcggtttccaggccatagtcgatgccttcgccgttcagcgggttcacacacgcggcggaatcgccgatcagcatccagttcgcgccagccacattcgacaccgcgccgcccataggcagcagggcagaggcgacgtcgtgctcgggcccgagttgccatgctttacgacgctgacccgcatagaagctcaacaatttcttcgtattgatcttcgctggtctcgtatccgtcgagagcgcgccacaacccaaattcaccgtgccgttgcccagcgggaaaatccacccatatcctggctgcaccacaccatcttcatcgcgcagttccacatgggagtgaatccacggttcatcagacagcggagtttcacaataagcacgagccgcaatgccatacacctcatcgcgttgccactgcctacccagtttcttaccgaaaggggagcggacaccatcggcaataatcacatgcttcgccttgacggttttctcttgccctgcgtgattaatcacaacgccttccaagaaattccccctcaaaatggggtcttgggcgctcgcgttctcccacgtggttacttcctcatgagattttgccaagcggaataacaaatcatcgaactccatccgcgacatcgcggaacccttattcgtgaaatatgtctccggccacggcgcctcaacagagccaccaaaaccatgcagtttcaagcccttgttgaaataatccccggtaacctgatcagcaacacctagaagttctagctggtgaatcgcacggggagtaaggccatcgccacacgttttatcccgcgggaaggaggaggcgtcgataagcaatgtttgaagcccagtcctggccgcatggacggcggcgctggcacctgaggggcccgcgccgatgatcaacacatcaaaagttgtagacacaaaccccattgtctcagtccggagagcaagaagactaacccaaggtgcttcaagtgccttccgtcgactacggttaaacaaaaagctttttgtccatttcactggattcaccgaaagaatgaatccacactcgatcaccaaaggtagcgatgaatgagtagcggccgaaccgttccaacccgttcccacgggctcggaaaagaaggtgtatccaccacaggagcatctcaggtcgagtttggtgatcccgagctaacggccaggatcaatgacgccatggtgcaggtagaagaactcctgcacactgaactatcgtccggggaagacttcctcgtcgatatcgtcatgcacctaacacgagccggcggcaaacgattccgccccatgtttgcactgctggcctccgagttcggtgaaaaaccactctccgaaaacgtcatcaaagccgccgttgtcgtagagatcacccacctggccaccctgtaccacgacgatgtcatggacgaggcatccatgcgccgcggcgtcccaagtgctaacgcgcgatgggacaactccgtagccatcctcgcaggcgacatcctcctagcacatgcatcaggtctgatgagtcagctgggtaccgacacagtcgcccactttgccgaaacattcggcgaactagtcaccggccaaatgcgcgaaacagtcgggccacgcgacaccgacccgatcgagcactacaccaacgtaatccgtgaaaaaactggtgtcctcatcgcctccgcaggctatttgggagccatgcacgcaggcgccgcacctgaacacatcgacgccctgaagaacttcggcgcagccgtcggcatgatcttccaaatcgtcgacgacatcatcgacatcttctcggaaacccacgaatccggaaaaacgcccggcaccgacctccgcgaaggtgtattcaccctcccagtgctctacgcactccgtgaagacacccccgtcggcgcagaactccgcgacatcctcaccggccctctagaagacgacgagaccgtcaaccacgtcctcgagctcctctcccaatccggcggacgccaagcagccctcgacgaggtctaccgctacatggacatcgccaacgcagaactcgaccgcctcccagacagcaccgtcaaggaagccctccgcaaccttgcaaccttcacagtcaagcgcgtcggataaccccgtaatccaccacttaacctgccgatttgcataacaggcggggtctcatagtaaagtatgaggcgcaccaaacgaggtgcccgccagattgcccgagcggccaatgggagcggactgtaaatccgtcggcttgcgcctacgtaggttcgaatcctacatctggcacaatcacccgctgcactttcttaggaaagtgcagcgggtttttgcatgcgtggactttttgaggatctttctgggatccccagaggagtagcggcggcgttggctccgtaagttcgatttcacggtagcggtttctcaactacggtttcttgcgctcaatttcttaagagcgatttcactcggtttttggtggttttgcgaatggtctcgaaggtaagaaattggatttgagaaattgtatttgaggtatcgaacttaagtgggggagtccttcgcctcgatatggcggcagcagtcctattgctcgacttcgcgtgtgctgacttctcatactcaacttctcgtcagacgacttcagtaggaaatcctgacagcaccgactgaagtcgagcataagaagtcggtgttaagatgtcgtcgttgaggtgttgccttcgagaaattgaacttaaggcaaccacaccaagcgtctgttgcagataactcaatccattgtcactttagggcgtctttgagtgctgaaaagtggcgcctgaccagtgattttgtgtttcttcaagttcacgctaatctacttaagacttcaacggagcacagccaggctgtttttgaagaagtagatgcccccttagctcagtcggtagagcgtttccatggtaaggaaaaggtcaacagttcgattctgttagggggctctttttgcatttctggaccattttggaatcatttctggatctctttaggtcacaaatgcacacctggcagacgcactcaaggcgtgagtttttagtttcaggccacatgcatcgcagtaggggtgcaatttaatccaagaaaacctttagcttcctgcagatttgtgttgcggtagcggttcgggttaaagttcttaaggcttcaacggagcgcagcggtagttatacggactgcatttcaaagagcttgacgcccccttagctcagtcggtagagcgtttccatggtaaggaaaaggtcaacagttcgattctgttagggggctctgttgcttttattctcgtaagagatgttgagcaatgtggcggtgtagctcagtggtagagcaagcgactcataatcgctgtgtcgcgagttcaattctcgccatcgctaccgcggatgaaaccgcttctaactgcaaattttttgaggttagaagcggtgttttcgcaaattgacaggctgatggtaacattgcctgtgctccataggggcgtagctcaattggcagagcaacggtctccaaaaccgtaggttgcaggttcgattcctgtcgcccctgcaagatgaacacccttgatctggttaaacaataaaaccagatcaagggtgttttttgtttcatcaagggatctttcacctgtagcaggtatgtcctaataaatattgcgagggttcgcgggattaatgtactctcgaaggttgaacacagggctgcgattgtgctggatcaaatgtctgcacgaaaaattgttatcgcccctggatgagtagtgatttagaggagtgctgtgagcgacgagcagaattctggcgtaggcggaacgtctcgcccaacgggtaaacgccagctgtcgggtgcttccactacctctacctcttcttatgaggctaagcaggtatctacacagaagaagtcatccggttcggattctaagcctggcggcggtgttatttcttttctgcctgaggttgtgggagaagtccgtaaggttatttggcctactgcgcgccagatggtcacgtacacccttgtcgttttgggattcttgattgttttgaccgctttggtgtctggtgtggatttcctagctggtcttggagttgagaagattctgactccgtaggtaggatgtgtaacatcttttttgaaaagtcccgctggttccctggaggagccggcgggataatttttgcccaggtggttggtttggggcagcggttgcaattggatgtaattggttgtttgtcgcagtagcatgggacgaaagctgttagatagcatgttgcatccctgcgttggctgattatcgctgggttttagggtcgatagataggttgggagaacacgcattatgagcgatgagaacattaacgagtttgagcaggacgaggatctgaacttcggcgcgagctttagtgatgaattcgcagatgacgatttcgatgcagaagcagacgtagaagcagatgctgctgcagaggcctctgccctggaagctgagcaggatctggaagaagagaccctagatgctccagaagaagccgcagaagaagctcctgctgctgcagagtccgaagctccagtagaagaggacgaagaggctgacagccttgctcaggcggctgctgcacttggtgacaccgatgagcaggacgcggatgcagagtacaaggctcgtctgcgtaagttcactcgtgagctgaagaagcagcctggtgtttggtacatcattcagtgctactccggctacgagaacaaggtgaaggcgaaccttgacatgcgtgctcagacccttgaggttgaggatgacatctttgaggttgttgttcctatcgagcaggtcactgagatccgtgatggtaagcgcaagctggttaagcgtaagttgctgccgggctacgttttggtccgcatggacatgaatgaccgcgtgtggtctgttgttcgcgatacacctggtgtgaccagctttgtgggtaacgagggcaatgcaactcctgtgaagcaccgcgatgttgcgaagttcttgatgcctcaggagcaggctgttgtcaccggtgaggctgctgctgcggctgccgagggtgagcaggttgtggctatgcctaccgataccaagaagcctcaggttgctgtggacttcactgttggtgaggctgtgaccattctgactggtgctttcgcttctgtttctgcaacgatttcttctatcgatcctgagctgcagaagctggaagttttggtgtccatctttggtcgtgaaactcctgttgatctcagcttcgaccaggttgagaaggttagctagtagctaaactgcaccacttaccccgcatttcctaggccacatataagggctttggtgatgcggggttttgcgtgtagggtagacaatcgcgtgttttttaagcatgctcaaaatcattcatccccggtggcccggttacgtaaagatcagcaaagatgatcaactaaagcgatcatctgaagttgtagcgggaccgagcatccggacggttactagtggggtttcatcgtcccagttgtggccggtaacaaggaagcaggtttaacgatggctcctaagaagaagaagaaggtcactggcctcatcaagctccagatccaggcaggacaggcaaaccctgctcctccagttggcccagcacttggtgctcacggcgtcaacatcatggaattctgcaaggcttacaacgctgcgactgaaaaccagcgcggcaacgttgttcctgttgagatcaccgtttacgaagaccgttcattcgacttcaagctgaagactcctccagctgcaaagcttcttctgaaggctgctggcctgcagaagggctccggcgttcctcacacccagaaggtcggcaaggtttccatggctcaggttcgtgagatcgctgagaccaagaaggaagacctgaacgctcgcgatatcgacgctgctgcgaagatcatcgctggtaccgctcgttccatgggcatcaccgtcgaaggctaaaagctttcacaccggttagtggctcattcaaaatgaatggccaccaaccaattttcaccaaagttttatgtggcagggccagctccggcccgttaaaccacagaattccatgaaagggaatttctaatgagcaagaactctaaggcgtaccgcgaggccgctgagaagatcgacgctggtcgcatctactccccactcgaggctgcaaacctggtcaaggagacctcctccaagaactacgacgcttccatcgacgtagctatccgcctgggcgttgacccacgtaaggctgatcagcttgttcgtggcaccgtctccctgcctaacggcaccggtaagaccgttcgcgttgctgtgttcgcacagggcgagaaggctactgaggctgaggctgctggcgctgacttcgttggcaccgacgagctcgttgagaagatccagggtggctggaccgacttcgacgttgctattgcaacccctgatcagatggctaagatcggccgtatcgctcgtgtcttgggcccacgtggtctgatgcctaaccctaagaccggcaccgtcaccaacgatgtcgctaaggctatcgaagaggtcaagggcggcaagatttccttccgcgttgacaaggcttccaacctgcacgctgcaattggtaaggcttccttcgatgcgaagaagctggctgagaactacggcgctctcctcgacgagatcatccgtatcaagccttcttccgctaagggcatctacgtcaagcgcgtgaccctgtcttccaccaccggtcctggtgttgaggttgacactcacgtcaccaagaactacgcagaagaggcataagccttcccacgcgtaactctttaggccccatgctttgcatggggtctttttattgcttttcgacgtctccctccttcgttgcgatcactaagagcagctccgctctggtcagtggatcattgaggtcgatttcgcagatctcttcaatgcggatcatgcgggtgcgcacggtgtggcggtggatgcccagttctttggcggtgtcgcctatatgtccgctgtgctgagtaaaagacaccaaggtgggggcgagctcggtgttgttggtgcggtcgtggtcgaggagacggtcgtaggtgtcgcgggatcggatcttaaggattttgcgcagctcggggttttggagccacagcaaggtgccgtcacggggttcggcgtgggttccaagttgtagggtttttgcggtggcagtgagttcgcggatgagtttcttatcgatgttttccgctcgggtgggcagaccaatgcagaggcgaactccgcttgcggcagtaccaaaaagttgcacgatgttgtgcacgctgcggcttccgcgaaggaagaggagttcggtggattcggcgaggcgtagatgagctagtgctcgttcctgtttgtacagtgcggtggcgacactggagagtgcttttcgtactgattggggtgtgttgccggtgatgaggatggggcggatatttccggaagcatcagtgatgtcagcgaacacgcggtgaatggtggctaggtcgtcgcttcgacccagaagtagtgacatggcaagtgagcgcacttcgatttctcggtcgcgcatggcttcggggcgttgaagcaaaatatcggcaaggcctgcgcagtgtctgatcagtgcgcggtgttgttcgctggggcgggtgggcataaggactgagagcacgtggtggcggtcgccgtaccgggtcatacggtggatgaatccaaagttggtggcatccgtgagtgcttgactggatccgttaaggcgcgagacagcttgggggagtgcgtctaggtcatcggtggtaatagagcaagccacgcggccgtcgctgtccacgatggctactgcaccacccaaatagtcggcggcagcacggcacagggcttcgatgccaccggagatggcgatggagttaagccgttcctgttccaggaggagttcttgttgcaggcggccggcacggcgggtttgctcatcacgcacgctggaggtgatcgagataaatggaatttcacgggggacttcaaagaggccgaggccaaggtggagggaggcgtcgataagcgcctgcggaacctgtgggaaggtgaggccggagccgaacccgatcgcgatgacccctgcgtcggcgagtcggtgtgcccaatcgcgaagcccgtcgggcgtttctgcgaaggcgatgccaacggataagaccacgctgttggggctgatgaagtcggtggggtcaacgagttcgctgatttggatgacatcgaaggttttgtttgtggggagaatttcgcggagtttgagctggctttgggtgtataaccagcggacatccatgtcttgggttggggtttccatggcgttaaactcctgtcaattatccatatgggcgaaatattgtctacaacttcgccctcatggacatattaacttcgttgcctcggagagaatactcatcacctagacaacagtttgtatctcacctcacaggaggaaccgtggaagatctctcataccgcatcccgcagtcgcgcaccgtggccgagcaggtgccagggccgaagtcgaaagcgctggatgagcgtcgacaagcagcagtagcacgagcacttgcaccgggtctgcctggatacgtggtggacgcagacggtggcatcttggctgacgcggacggcaaccgtttcatcgacctggcctccggcatcgccgtgaccacggtcggcggatccaacgcggccgtcgcgaaagccgtcggcgccgcagctgcccgcttcacccacacctgcttcatggtctcaccttatgaaacttacgtggccatggcggagagactcaacgccttgactccaggcgatcacgacaagaagagcgcgctgtttaactctggcgccgaagccgtggaaaacgccgtcaaggtggcacgcgcctacaccggcaagggcgcggtcgtggtgttcgacaacgcgtaccacggacggaccaacctcaccatggcgatgaccgcgaagaaccgcccatacaagtccggattcggaccactagccgcagacgtctaccgtgcaccaatgtcttacccactgcgcgacggactgtccggcccggaagccgcagagcgcgcgatctccgtgatcgaatcccaggtcggagccgaaaacctcgcctgcgtggtcattgaaccgatccagggcgaaggcggattcatcgtccccgcaccaggattcctcgcagccatttccacctggtgccgcgagaacgacgtggtgttcatcgccgatgaaatccaatctggcttcctgcgcaccggcgactggttcgccagcgacgcagaaggtgtgatccccgacgtcatcaccaccgcaaaaggcatcgccggcggcatgccactatccgcagtgaccggccgcgcagaaatcatggacgcacccggccccggcgcgctcggcggaacctacggcggaaaccccgttgcttgcgccgcggcacttgcagccattgaagtgatggaacaagccgaccttaagacccgcgcgcaagaaatcgagaccatcatccgcgatgaattcgcgcagctgagtgccttcccggaggtcgccgaaatccgcggccgcggagcaatgatggccattgagcttatcgacgctaccggccgcccgaacgcagctttaaccgccgcagtggctgcgcgcgcaaaagctgaaggtgtgctgctgctgacttgcggcaccgatggcaacgtcatccgcctgctgccaccactggtcattgcagaggacactctccgtgatggtcttcaggtgttagtcgcagccctagagcgcgaaaccgcgcaccagaaggtgggctaaagtgtctttgaccttcccagtaatcaaccccagcgatggctccaccatcaccgagctagaaaaccacgattccacccagtggatgtccgcgctctctgatgcagttgcagctggtccttcatgggctgcgaaaactccccgcgaaagatccgtggtactcaccgcaatcttcgaagcactgaccgaacgcgcccaagaacttgcagagatcatccacctggaagctggaaaatccgttgcagaagctcttggtgaagtcgcttatggtgcagaatacttccgttggtttgcggaagaagcagtgcgcctgcccggccgctacggacagtcaccttccggaatcggtcacatcgccgtcacccgcgcacccgtgggaccagtgctggcgatcaccccatggaatttccccatcgccatggccacccgcaaaatcgccccagccctggccgctggttgccccgtgttggtgaaacctgcttccgaaaccccactgaccatggtcaaagtgggggagatcatcgcctccgtctttgatacctttaatatcccgcagggcttggtctcaatcatcaccaccactcgagatgcagagctatcggcagaactcatggctgatcctcgcttggctaaagtcaccttcactggatcaaccaacgtgggacgcatcctggtccgccaatccgcggaccgactgctgcgcacctccatggaactcggcggaaatgcagcttttgttatcgacgaagccgcagacctcgacgaagccgtatccggtgccatcgccgcaaaactccgcaacgccggccaagtatgcatcgcagctaaccgtttcttggttcatgaatcccgcgctgccgaattcacctcaaagctggcgacagccatgcagaacactcccattgggccggtgatttctgcccgccaacgcgaccggatcgcagcactagtggatgaagccatcaccgacggcgcccgcctcatcatcggtggggaggtccccgacggctccggcttcttctatccagccaccatcttggccgatgtccctgcacagtcacggattgtgcatgaggaaatcttcggacctgtggccaccattgccactttcaccgacttggccgaaggcgttgcacaagcaaattccaccgaattcggcctcgcagcctacggattcagcaacaatgtgaaagcaacacagtacatggcggaacacttggaagccggaatggtcggaatcaacagaggcgccatctctgacccagcagcaccttttggcggcatcggacaatccggcttcggcagagaaggcggaaccgaaggaatcgaagaatatctctccgtgcgttacctcgctttgccgtgacacatgagctgtccggtgaataacccgaaggaaaaaacatgactaccgaatcaatagttgcgcacaatgctgcaggtacagcacctcagaatgtgtcctctgctaagaagaagtacctcagcgttgcccaaggcgttgcccttatctacggaaccaacatcggcgccggtgtgctcagcctcccatacgctgcccgcaacggtggtttcctcgccctggttgttgccctgctcattgcgggaacactgaccaccatctccatgctctacatcgccgaagtatccctgcgcaccaagaagccactgcagctttccggcctggcagaaaaatacctggggcagtggggccgctggctggtgttcattgccattgtggtcaacagcgtgggtgcactgattgcctacgcatcaggatccggcattttgataggcaacctcaccggcctgccaccaatcgtgggcacccttggattctttgttttaggcaccttgatcatgtggaaaggcctgcacacggcaagcttcgtggaggcattgatcaccactggcatggcaacgatcatcatcgtgctgtgtggatggacagtgcttggccctggaatttccgcagacaacctgatcgtgttccacccattcttcatcgttccgatcatgaacctcgcggtctttaccttccttgcccaatatgtggttccagaaatcgcacgaggagttaaccctgccaccccgaaggcagtgccacgcgcgatcatcatcggcatggtcgcaactggtgtcaccctggcagctgtaccattcgcggcactagggcttctgggcacaggcgtcagtgaagttgtcaccatctcctggggcgaagcactcgccccagtggcctattacatggccaatgccttcgcactattggccatgttcacttcattcatcgccattggattcaccgcgatgcgcaacgtactagatattggccactggccacaacacggatggcagcgatccgttgctgtcggactaactgttcttccaccactggcaatttcacttgcgggattaggcggattcgtggcagcactgagctacgccggaggatttgccggagcaatcatgtccatcatccccgtgctgttgctgcgcaactcccgcaagagtggtgaccaagaaccagtgtggaaagccacctggcaagcgcaccccatcttccagatcctgttgattgtggtgtactccctggcgtttgtgtactcggttctcgcgatcgtcggattaatgcctgcgggttgggcatagtcacttcctgttgtggctgcctgttgcagccaaatacggccaacggctccttggaaatttaaggggtcgttggccttattattttagggaaagcccatccttaccttgccaagggaagcctgtacatgctggtcagggacatttttatgggtgataatggggttatgaataaaaaacttaataccccaaatccctggatgttattcatccgctcatttgatggcatcatcactgtcgcagcccttgttgccatcgcaatacatctcattttatggctggctctagatctagatggccttgctaaaaactggcctttaatagccatcgttatcgtaggtggcattccgttgatgtgggatgtgctgaaatcagccattaaaactcgcggtggcgcggatactttagcagcagtctccatcattacttctgtgttgttaggggagtggttggttgccgcgatcatcgtgctcatgctctctggtggtgaagcgctagaagaggcagcatcacggcgagccagtggcaccttggacgcacttgcccggcgcgcaccaagtacagctcaccgcctgttgggtgcaaccattcttgatggaaccgaagagatcgccgtggaagagatcacggttggtgatttagtggcggtgctcccgcatgaactttgtcccgtggatggtgaaatcgtggcaggccacggcaccatggatgagtcttatctcacgggtgagccctatgtggtgagtaaatctaaaggttcgcaagcaatgtcgggtgcagtcaatggtgatactccgctgacgattgttgccacaaagcttgcccatgattccagatacgcccaaattgttggtgtactccatgaagcagaaaacaaccgcccagaaatgcgcaggatggctgaccgtcttggcgcgtggtatacggtgattgcacttgccctcggtggtcttggctggattgtctccggcgacccagtgaggttcttggctgttgtcgttgtcgccaccccatgtccattgctcattgcagtgccagtggcgatcatcggtgcgatttctcttgcggctcgtcggggcatcatcgtgaagaaccctggaatgctggaaaacgcttcaggagtaaagacagtgatgttcgataagactggaacgctcacctatggcaggccagtgattactgatatccacactgctcccggagttgaggaagatacagtcctagctttggctgcttcagtagagcgctactccagacacccgttggctgacgcgattcgtgagggcgcaaaagccagggaacttcatctgcctgatgtagtggaagtatcggaacgtccaggacagggactaaccggcacggtgggcgagcacctggttcgaataaccaataggcgcagcacactagaaattgatccagacagcaagaactacattccggtgacaagttccggcatggaatctgtggtgcttgttgatgataaatatgcagcactcattcgcctccgggatgaacctcgtgcatctgccagtgagttcatcgcgcacttgcccaagaagcacaaagtggacaagctcatgattatctctggtgatcgcgcatctgaggttcgttaccttgcggacaaggttggcattgatgaggtacacgcagaggcctcaccggaagacaagctgaacattgttaatcggcataatgagcacggcgccaccatgttcttaggtgatggaatcaacgatgcgccagccatggccgttgccaccgttggtgtcgcgatgggagcagactccgatgtcacgtccgaagcagcagatgctgtgattttggattcttccctggaacgtctcgacgatctgctccacatcagtgcacggatgcgtcgaatagcgttgcaatctgcgggcggtggcatggcgttgagtgtcataggaatgatcctcgcggtatttggattcttgacgccactgatgggtgcgatcttccaagaggtcattgacgtgctggctatcctcaattccgctcgggtcgcactgccacgcggagcgattagtgattttgatacgcaagaaaaagtttcttagcagggtaacctaaatgtcgtgacatttcgaggcggaaacactggcgcaaagcacgcggtcgttgttggttctggccccaatgggttgaccacggcggcggtgctggccaaagcaggttggcaagtagatgtgtatgaggcggcgccaacccctggaggggcggcgcgctcagaaagcgttctgggggaggggactatcagcgatttgggtgccgcagggcatcctttcggggtggcaagcccagcttttcactatttgggtctggaagatcacggcctggaatgggcgtattctccctttgcgatggcccacccgttagattatggcagggccggactgctggaaacgtcactcccagagaccgccaaaaagcttggacctgatgcacgtcgttggaagaatttgcaccagggcttaaccaaaaacattgataaacacttggccaatctattagggccggtgctgaaatggccagcacatccgattcggatggcaaagtttggcccatttgcgttgctgcccgcgaaacgtctagccagtgccgcttttgaaacagaagaagcccgatccctgtttatcggttcggcgatgcactcggtgactccaccacacaagccgatgaccgcatcacttggattgctttttggcgctctggggatgtcgcgaggatggccggttgcagttgggggaagcggacggatcgtcgatgctctggtcaatgtcataaaccatcacggtggcaccattcactgcgattcacagattgattccctctcacaattccgcgacaccgatgccattattctgaaccaaaccccctcacaggtgctgaaactcaaaggaactgaccttaatgcagggcttccgcaacgcatgagcacctggaaacacggaccaagttcctacaaagtggactacctcctcgacggaccaattccctggagcaatccccaggtaggccaggccacaaccgtccatgtgggcggaagctctgaggaaatcgctttcgcagaagcagaagtcgcagcggggcggatgcccgaacgcccgtttatcattttgtgccaacaacaagtggcggatccttcacgcgcccgggaggggcgccacgtcgtgtgggcctacgcgcatgtgccgcggggtttcgtcgataagcgagctgctttattaatcactgcgcagattgaacgcttcgcccccggtttccgtgatcgcatcgtgcattcagtggataccaacgcggaggatttagaggcgtggaaccccaatcttgttggcggagacatcaccgcagggtccgcgctgcttcggcgaatgccgaccaaaatcggcgagaaaacgtacatggcatccgcctccaacgcgccgggcgggggagtccacggaatgcccggctggtgggcagcgcaagccgttttagcagatcacaggtagaattgcgacatggagcccaccgtaaaagccagcgcgcgccacaccatccacgtcaccgccgacacctggcgcatccgcctgagtgcctcagcccactcacaccccaacgacgcgtacgcgcgccgggctacggcaatttccgccataggcagcgtgcttatcgacgtccccctccaaggcgaacgcatctctgaatccactgcatacgacggccaaatcaacgccgactggaacgcagaagtcaccggcaccgatgtgaacatcgcacgcgacatcatctcccggctcgcagcggtgccagacgttcaagtcgacggcccgttgtggtccttgagtgacagtttggctgcagaggctgctgtggaggcattgcaaggtgctgccgacactgcgcggaacaccgcgaccgccatcgcagaatccctcggcgggcagctaggtgcacttctctacgcaacaaccgacacccacagctccacaccgataccagcacgcgcagaaatgatggcagcaaaagcctccataccaccgcgcacactcgacctagaactcgccccctctgacatcgaagtcaccaaagaaatcgccgtgacctttgaattccttgcaggctaaaccgcgatttggtatttcggccgatcctgccctaaagtaatagaccgaagtttgaacgatcggccacgcgccagatcgagctcaaggttcaccgaagaccgtaggtcatccgcatgacggatcgaaggtttcctacccttaggaacggcccacgcaggagacacttgaacgccttagattccttatgtggaatgtatagcgccctgtgctcttgcacggggcttttctcattggtttattgaccgtgtgaaagctccgcggatcagtagattacacataagaggaaggaggcgaagtaatggcaaacccaagaaacgaagcagctctggcagagctcaaggcacgtttcgctgagaccgacaccgtcgttctcaccgagtaccgtggcctgaccgtggctcagaccaccgaactgcgtaaggcactgggcttcgatgtccagtactccgtcgccaagaacacccttgttaagatcgccgctaacgaagctggcgtcgagggccttgatgatctcctgaccggtccaaccgctgttgccttcatcaagggcgaagcagttgacaccgctaaggtgctgaagaaattcggcgaagaaaacaaggcattcgtagtcaagggtggctacatggatggcaacgcgctgaccgctgaacaggtcaacgcaatcgccgagctggacaaccgtgagaccactctcgcgaagcttgccggcgccatgaagggcagcttggcaaaggccgcaggcctgttcaacgctcctgcttcccaggtcgcacgcctcgccgttgcgctccaggacaagaaggacgcataagtcgccaccaggcgcaccagttttaccccaaactttttcgagcgtgttaaacgctcaacaacaggaaggatgccaccatggctaagctcaccaaagacgagctcatcgaggctttcaaggaaatgaccctcatcgagctctccgagttcgttaaggaattcgaagaggtcttcgacgtaaccgcagctgctccagttgcagttgctgctgcaggcgctgcaggcggcgaagctgctgctgcagaagagaaggacgagttcgacgtcgttctcgaagacgcaggcgcaaagaagatcggcgtcatcaaggctgtccgcgagctcgtctccggcctgggcctgaaggaagcaaaggagctcgttgagggcgcacctaaggctatcctcgagggcgcaaacaaggacgacgctgaggctgcaaaggctaagctcgaagaggctggcgcaaaggtcacccttaagtaagaactttcttacaccttttcaaaaccccacaccctggactcgatccaggggtggggttttgtgctgtctggggtgggtttgggttgggttttggggtttgttggggtcggcggtgtcttaagttcgatttcacggtagcggtttctcaactacggtttcgcgggctcaatttcttaagagcgatttcactcggtttttggtggttttgcgaatggtctcgaaggtaagaaattggatttgagaaattgtatttgaggtatcgaacttaagtgggggagtccttcgcctcgatatggctgcagcagtcctattgctcgacttcgcgtgtgctgacttctcatgctcaacttctcgtcatacgacttcagtaggaaatcctgacggcgccgacggaagtcgaccacgtgaagtcgagtgtgtgaagtcgccctttaaggcccgtaaagcactccacaacacttcacggcaggccgtaatttccctgtgaggtactttcttgcaagttgtagcgcaccgccgataccaatgcctggcgggtgctccggtaacatcgtccgcatgctgcctaaatcccggattttctccgcaatcttgctcggaattggtgtggcacttgtggtctggggtctggtggctccgcgctttgtgcacgctgatggccgtttgcctcttgatttggaggcgacgacgtacgttctccatgactctgacgctcagaccactattaattctgatccgttggccggtgtggtgactacgccggtgactcgtcagttgcattttgaggtgatggatccggcgagtgctgatgatgccactattcgtattggtgattcgatgttgcgtggtaatcctgatactcagggttttgagcaggaacggctcctgtcagcgactgtgtcgagtttccgcattgatcgcacctctggtgaggttttgtccgatattgcgctgactaatcagttggcgagccctacggtgcagtattcggtggatggcatttggttgaagttcccaactgacgcgcaggagaccacttacaacgtggtggatccggtgctgaggtctgcgctgccggcggattttgtggagtccacggagatcgatggccgtgaggtgctgcattaccgtcaggtgattgataacgtgaatgtggcggagtatttcgcggatgccaacaacaccaccacgttgactaaagaggatggcggtaccacgacgggctatttttatcacaatgtgactcgtgatttttgggtggatcagcgtaccggtttggttgtcgatctagctgaaaatattgatgatttttacggcgaccgcagcggccagaagtacgaacagaaattgcttttcgacgcctccctcgacgatgcagctgtctctaagctggttgcacaggccgaaagcatccctgatggagatgtgagcaaaatcgcaaataccgtaggtattgtgatcggtgcggtattggctctcgtgggcctggccgggtgttttggggcgtttgggaagaaacgtcgagaagcttaacctgctgttcaaatagattttccctgtttcgaattgcggaaaccccgggtttgtttgctagggtgcctcgtagaaggggtcaagaagatttctgggaaacgcgcccgtgcggttggttgctaatagcacgcggagcaccagatgaaaaatctcccctttactttcgcgcgcgattggtatactctgagtcgttgcgttggaattcgtgactctttttcgttcctgtagcgccaagaccttgatcaaggtggtttaaaaaaaccgatttgacaaggtcattcagtgctatctggagtcgttcagggggatcgggttcctcagcagaccaattgctcaaaaataccagcggtgttgatctgcacttaatggccttgaccagccaggtgcaattacccgcgtgaggtgctggaaggacccatcttggcagtctcccgccagaccaagtcagtcgtcgatattcccggtgcaccgcagcgttattctttcgcgaaggtgtccgcacccattgaggtgcccgggctactagatcttcaactggattcttactcctggctgattggtacgcctgagtggcgtgctcgtcagaaggaagaattcggcgagggagcccgcgtaaccagcggccttgagaacattctcgaggagctctccccaatccaggattactctggaaacatgtccctgagcctttcggagccacgcttcgaagacgtcaagaacaccattgacgaggcgaaagaaaaggacatcaactacgcggcgccactgtatgtgaccgcggagttcgtcaacaacaccaccggtgaaatcaagtctcagactgtcttcatcggcgatttcccaatgatgacggacaagggaacgttcatcatcaacggaaccgaacgcgttgtggtcagccagctcgtccgctccccgggcgtgtactttgaccagaccatcgataagtcaactgagcgtccactgcacgccgtgaaggttattccttcccgtggtgcttggcttgagtttgacgtcgataagcgcgattcggttggtgttcgtattgaccgcaagcgtcgccagccagtcaccgtactgctgaaggctcttggctggaccactgagcagatcaccgagcgtttcggtttctctgaaatcatgatgtccaccctcgagtccgatggtgtagcaaacaccgatgaggcattgctggagatctaccgcaagcagcgtccaggcgagcagcctacccgcgaccttgcgcagtccctcctggacaacagcttcttccgtgcaaagcgctacgacctggctcgcgttggtcgttacaagatcaaccgcaagctcggccttggtggcgaccacgatggtttgatgactcttactgaagaggacatcgcaaccaccatcgagtacctggtgcgtctgcacgcaggtgagcgcgtcatgacttctccaaatggtgaagagatcccagtcgagaccgatgacatcgaccactttggtaaccgtcgtctgcgtaccgttggcgaactgatccagaaccaggtccgtgtcggcctgtcccgcatggagcgcgttgttcgtgagcgtatgaccacccaggatgcggagtccattactcctacttccttgatcaacgttcgtcctgtctctgcagctatccgtgagttcttcggaacttcccagctgtctcagttcatggaccagaacaactccctgtctggtttgactcacaagcgtcgtctgtcggctctgggcccgggtggtctgtcccgtgagcgcgccggcatcgaggttcgagacgttcacccatctcactacggccgtatgtgcccaattgagactccggaaggtccaaacattggcctgatcggttccttggcttcctatgctcgagtgaacccattcggtttcattgagaccccataccgtcgcatcatcgacggcaagctgaccgaccagattgactaccttaccgctgatgaggaagaccgcttcgttgttgcgcaggcaaacacgcactacgacgaagagggcaacatcaccgatgagaccgtcactgttcgtctgaaggacggcgacatcgccatggttggccgcaacgcggttgattacatggacgtttcccctcgtcagatggtttctgttggtaccgcgatgattccattcctggagcacgacgatgctaaccgtgcactgatgggcgcgaacatgcagaagcaggctgtgccactgattcgtgccgaggctcctttcgtgggcaccggtatggagcagcgcgcagcatacgacgccggcgacctggttattaccccagtcgcaggtgtggtggaaaacgtttcagctgacttcatcaccatcatggctgatgacggcaagcgcgaaacctacctgctgcgtaagttccagcgcaccaaccagggcaccagctacaaccagaagcctttggttaacttgggcgagcgcgttgaagctggccaggttattgctgatggtccaggtaccttcaatggtgaaatgtcccttggccgtaaccttctggttgcgttcatgccttgggaaggccacaactacgaggatgcgatcatcctcaaccagaacatcgttgagcaggacatcttgacctcgatccacatcgaggagcacgagatcgatgcccgcgacactaagcttggcgccgaagaaatcacccgcgacatccctaatgtgtctgaagaagtcctcaaggacctcgacgaccgcggtattgtccgcatcggtgctgatgttcgtgacggcgacatcctggtcggtaaggtcacccctaagggcgagaccgagctcaccccggaagagcgcttgctgcgcgcaatcttcggtgagaaggcccgcgaagttcgcgatacctccatgaaggtgcctcacggtgagaccggcaaggtcatcggcgtgcgtcacttctcccgcgaggacgacgacgatctggctcctggcgtcaacgagatgatccgtatctacgttgctcagaagcgtaagatccaggacggcgataagctcgctggccgccacggtaacaagggtgttgtcggtaaaattttgcctcaggaagatatgccattccttccagacggcactcctgttgacatcatcttgaacacccacggtgttccacgtcgtatgaacattggtcaggttcttgagacccaccttggctggctggcatctgctggttggtccgtggatcctgaagatcctgagaacgctgagctcgtcaagactctgcctgcagacctcctcgaggttcctgctggttccttgactgcaactcctgtgttcgacggtgcgtcaaacgaagagctcgcaggcctgctcgctaattcacgtccaaaccgcgacggcgacgtcatggttaacgcggatggtaaagcaacgcttatcgacggtcgctccggtgagccttacccgtacccggtttccatcggctacatgtacatgctgaagctgcaccacctcgttgacgagaagatccacgcacgttccactggtccttactccatgattacccagcagccactgggtggtaaagcacagttcggtggacagcgtttcggcgaaatggaggtgtgggcaatgcaggcatacggcgctgcctacacacttcaggagctgctgaccatcaagtctgatgacgtggttggccgtgtcaaggtctacgaagcaattgtgaagggcgagaacatcccggatccaggtattcctgagtccttcaaggttctcctcaaggagctccagtccttgtgcctgaacgtggaggttctctccgcagacggcactccaatggagctcgcgggtgacgacgacgacttcgatcaggcaggcgcctcacttggcatcaacctgtcccgtgacgagcgttccgacgccgacaccgcatagcagatcagaaaacaaccgctagaaatcaagccatacatcccccggacattgaagagatgttctggggggaaagggagttttacgtgctcgacgtaaacgtcttcgatgagctccgcatcggcctggccaccgccgacgacatccgccgttggtccaagggtgaggtcaagaagccggagaccatcaactaccgaaccctcaagcctgagaaggacggtctgttctgcgagcgtatcttcggtccaactcgcgactgggagtgcgcctgcggtaagtacaagcgtgtccgctacaagggcatcatctgtgaacgctgtggcgttgaggtcaccaagtccaaggtgcgccgtgagcgcatgggacacattgagctcgctgcaccagtaacccacatttggtacttcaagggcgttccatcacgcctcggctaccttttggaccttgctccaaaggacctggacctcatcatctacttcggtgcgaacatcatcaccagcgtggacgaagaggctcgccacagcgaccagaccactcttgaggcagaaatgcttctggagaagaaggacgttgaggcagacgcagagtctgacattgctgagcgtgctgaaaagctcgaagaggatcttgctgaacttgaggcagctggcgctaaggccgacgctcgccgcaaggttcaggctgctgccgataaggaaatgcagcacatccgtgagcgtgcacagcgcgaaatcgatcgtctcgatgaggtctggcagaccttcatcaagcttgctccaaagcagatgatccgcgatgagaagctctacgatgaactgatcgaccgctacgaggattacttcaccggtggtatgggtgcagagtccattgaggctttgatccagaacttcgaccttgatgctgaggctgaagagctgcgcgacatcatcaacaatggcaagggccagaagaagatgcgtgcactgaagcgcctgaaggttgttgcagccttccagcgttccggcaacgatcctgccggcatggttttgaacgcgatcccagtgatcccaccagagcttcgcccaatggttcagcttgacggtggtcgcttcgctacctccgacttgaacgacctttaccgtcgtgtgatcaaccgcaacaaccgtctgaagcgcatgattgagctcggtgcacctgagatcatcgtgaacaacgagaagcgcatgctgcaggaatctgtggacgcgctgttcgacaacggtcgtcgtggtcgcccagttaccggaccgggtaaccgtccgctgaagtctctgtctgacttgctcaagggcaagcaaggccgtttccgtcagaaccttctgggtaagcgtgttgactactctggtcgttccgtaattatcgttggtcctcagctgcgcctccacgaatgtggtctgcctaagctgatggctctcgagctcttcaagcctttcgtcatgaagcgcttggtggagaacgagtacgcacagaacatcaagtctgcaaagcgcatggttgagcgtcagcgccctgaggtgtgggacgtcctcgaagaggccatctctgagcacccagtgatgctgaaccgtgcaccaaccctgcaccgcttgggcattcaggctttcgagcctgtccttgttgagggtaaggctattcagctgcacccacttgcttgtgaagctttcaacgccgacttcgatggtgaccagatggcagttcacctgccgctgtccgctgaagctcaggctgaggctcgcgtgctgatgcttgcatccaacaacattttgtccccagcttccggtaagcctttggctatgcctcgtctggatatggtgaccggtctgtactacctgactctggagaagtcttccgaggagttcggtggacagggcgcttaccagcctgcagatgaaaacggtcctgaaaagggcgtgtattcctcactggcagaagcaatcatggcttatgaccgtggtgtacttggcctgcaggccccagttcgcatccgtttgaaccacctgcgcccaccagctgaggtagaagcagagcagttcccagatggatggaaccagggcgagacttggttggctcacaccaccttgggtcgcgttatgttcaacgagatcctgccttggaactacccataccttgagggcgttatggtccgtaagggtggcggctccgacaagatcatgcttggcgacgtagtcaatgacctcgctgctaagtacccaatgatcaccgtggctcagaccatggacaagatgaaggatgctggcttctactggtcaacccgttccggtgtgaccatcgctatgtctgacgttttggttcttcctaacaaggaagaaatgctggaccgctacgaggaatctgcacgccagatcgaagttaagtacaaccgcggtaagctcaccggccgtgagcgctacgaccgtctggtcgagctgtggaaggacgcaactgacgaggttggacaggctgtcgaggatctgtacccagacgacaacccaattccaatgatcgtgaagtctggtgctgccggtaacatgcgtcagatctggacccttgctggtatgaagggcatggttgtgaactcgaagggtgactacatcacccgcccgatcaagacttccttccgtgaaggcttgaccgttctcgagtacttcaacaactcccacggttcccgtaagggcctggccgataccgcgctgcgtaccgctgactccggttacctgacccgtcgtcttgttgacgtcgctcaggacgtcatcgtgcgtgttgaggactgtggcacccgccagggtgttcgcgttcctgtcgctgctgaggttctggatgcaactggtgctgtcaccggctacacccgccatgacctgatcgagacttctgtctccggtcgtgttctggctggcgatgcaaccaacgctgcaggcgaggttgtgcttgctgctggtaccgacctgaccgagctcaacattgaccttctggtcgaggctggcatcaaggacgtcaaggttcgttccgtacttacctgccagaccccaaccggtgtttgtgctaagtgctacggcaagtccatggcttccggccagcaggttgatatcggagaggctgtcggtattgttgctgcacagtccattggtgagcctggtacccagctgaccatgcgtaccttccaccagggtggtgtcggtggcgatattaccggcggtctgcctcgtgttcaggagctgtttgaggcacgtgttcctaagaactgtgcaccaattgcttctgttgaaggtgttatccaccttgaggatgaaggcaacttctacactctgaccatcgttcctgacgatggctccgacaacgttgtctacgagaagctgtccaagcgacagggtcttgcatccactcgcgtggctatggagtccaacgctggtgcgttcattgagcgcaccttgaccgaaggtgaccgcgtcaccgttggtcagcgtctgctccgtggtgcagctgatccacacgacgtgctcgagatcctcggtcgccgtggtgtggagcagcacctcatcgatgaggtgcaggctgtttaccgtgcacagggtgtggccatccacgacaagcacatcgaaatcatcattcgtcagatgctgcgtcgcggtaccgtcattgagtccggttccaccgagttccttcctggttctttggttgacctctctgaggcgaagctggctaactctgaggcaatcggtgcgggcggtcagcctgcagagctgcgttctgagatcatgggtatcaccaaggcctctctcgcaactgagtcttggctgtctgcagcgtccttccaggagaccactcgtgtcctgactgatgctgctatcaacaagcgctccgataagctcatcggcctgaaggagaacgtgatcatcggtaagctgatcccagctggtactggtatttcccgttaccgcaacatctccatcaagccaaccgaggctgctcgcaacgccgcatactcgatcccaacttatggtgagtcgatttacggtgacgatggattcggtgagttcaccggcgcatccgtcccattggatgaggctttctagagcaaggaaaccttaaatccagcacagctaattggtcgctgagaagttgaggccctggatctacttgaaaaagtagaaccagggtctcctttctttttgtacacagacgtggggaataaaacccttaaccccagattcttaggcaaatccccagatcagacctagttttataactatgtggaaactatctattggcatcgcagttggtgccatcttgttcggtttaggtctgtggggaacccactttgaagacaccgtcatctcgatcgcaggatgggtcggaacgttcgcgtcgtttgcggtgtggttctgggtcatttggtgggcagcggtaggaaatacaaaaagcccactctaagatggcagggtatggatgagctgctcaaacaggaagtcaaggatttcctcaccaccaggcgtgcacggattacgccggccgctgcgggactagaaacgcagccgtggagtgatcgtcgggtgccggggcttcggcgggaagaagtcgcggatctggcgggcatttctttggagtattacatccggtttgagcgcggaaatctcaagggtgcatcgcctgaaatattgcaatcgttggctaaggctctccaactgagcccaattgagcgcgaacaccttcacaatttggcttatcgcgccgaccatccgcgcaacctacctagtgcagagaccccaacggcacccctccaggacatcgttgatgcggtcacagataaaccggcgtggatccgcaacgagcagatggatattttggctacaaatcggctctgcgcggaactttacgccccgattttcaaggatctgcccgatcggcccaacactgcgcggcattgctttatcggcgcaacagcctccgagttctgggtggaccgggatcagttcagtgcggagttcgctgccaaactacgcctcgagtacgcccggcgccccagcgtgccaggtttaaaggagcttatcgacgagctccatcagaaaagttctgttttccgcgataattgggcgtctgctgatgttttgtcattcggctctggcatcaaacgtttcaggcacccaacactgggggagcgggtctatgaatacgagacgtttaatctcaatagtgcaccggggtatgtgttgagcatttacttttaggtggtggaggggcgcgtcgacaagctttttaaatgtttttcttggtgactacgctgactccgcccatgaacgccaggcctttgatgtggaccgtgggcgcgttgcttggcaggcgcgcgggattgagtgcaccggccttgtccacagactgttcgaagccgccgaaaatgcccatgccatcacaaatgacaaaaacaccctcgggaacaataatctcgatgccacccatgaatgtgtaggcgttgatctgaatgcggtcgctttccaggaaggcgtcgcgcaaatcgatctgattgccgcccatcatggcgaaggatgtgtgaacattaggcacatgccatccacctttgcgcacggtgccacccataaacgagaccgacattttggagccattcgggttgccggtaatcctgttgcggacaatatttacaggatctgacacattgggcatcgctgggggagtggtctcgtaggccgccggcgcataggaggcgccgggaaattgctgaccaagcagagtgtagggattgtcgttcacatcagagatcagctctacaagagtgtctaagtggcgggcattccatgctttggaggagcgatcttcaaattcctccaaagtgagttgacctcgggaaacagctgcagaaagttcatccacgacttggtttcggttaaggtcagtggcgagcttctttgctggttcgtttccttgaggaacagtcatgggaaccattctaacaagggatttggtgttttctgcggctagctgataatgtgaacggctgagtcccactcttgtagttgggaattgacggcacctcgcactcaagcgcggtatcgcccctggttttccgggacgcggtggcgcatgtttgcatttgatgaggttgtccgtgacatgtttggtcgggccccaaaaagagcccccttttttgcgtgtctggacactttttcaaatccttcgccatcgacaagctcagccttcgtgttcgtcccccgggcgtcacgtcagcagttaaagaacaactccgaaataaggatggttcatgccaactattcagcagctggtccgtaagggccgccacgataagtccgccaaggtggctaccgcggcactgaagggttcccctcagcgtcgtggcgtatgcacccgtgtgtacaccaccacccctaagaagcctaactctgctcttcgtaaggtcgctcgtgtgcgccttacctccggcatcgaggtttccgcttacatccctggtgagggccacaacctgcaggagcactccatggtgctcgttcgcggtggtcgtgttaaggacctcccaggtgtccgttacaagatcgtccgtggcgcactggatacccagggtgttaaggaccgcaagcaggctcgttcccgctacggcgcgaagaggggataattaaaaatgcgtaaatcagcagctcctaagcgtccagtagttcaggaccctgtatacaagtccgagctcgttacccagctcgtaaacaagatcctcatcggtggcaagaagtccaccgcagagcgcatcgtctacggtgcactcgagatctgccgtgagaagaccggcaccgatccagtaggaaccctcgagaaggctctcggcaacgtgcgtccagacctcgaagttcgttcccgccgtgttggtggcgctacctaccaggtgccagtggatgttcgcccagagcgcgcaaacaccctcgcactgcgttggttggtaaccttcacccgtcagcgtcgtgagaacaccatgatcgagcgtcttgcaaacgaacttctggatgcagccaacggccttggcgcttccgtgaagcgtcgcgaagacacccacaagatggcagaggccaaccgcgccttcgctcactaccgctggtagtactgccaagacatgaaagcccaatcacctttaagatcaacgcctgccggcgcccttcacatttgaataagctggcagcctgcgtttcttcaaggcgactgggcttttagtctcattaatgcagttcaccgctgtaagatagctaaatagaaacactgtttcggcagtgtgttactaaaaaatccatgtcacttgcctcgagcgtgctgcttgaatcgcaagttagtggcaaaatgtaacaagagaattatccgtaggtgacaaactttttaatacttgggtatctgtcatggataccccggtaataaataagtgaattaccgtaaccaacaagttggggtaccactgtggcacaagaagtgcttaaggatctaaacaaggtccgcaacatcggcatcatggcgcacatcgatgctggtaagaccacgaccaccgaacgcatcctcttctacaccggcatcaaccgtaaggtcggtgagacccacgacggtggcgcaaccaccgactggatggagcaggagaaggaacgcggcatcaccattacctccgccgcggttacctgtttctgggataacaaccaggtcaacatcattgacacccctggccacgttgacttcaccgttgaggttgagcgttccctccgcgtgcttgacggcgcagttgctgtgttcgacggcaaggaaggcgttgagccacagtctgagcaggtttggcgtcaggctaccaagtacgacgttccacgtatctgcttcgtgaacaagatggacaagctcggtgctgacttctacttcaccgttggcaccatcgaggaccgcctgggtgcaaagccattggttatgcagctcccaatcggtgctgaggacaacttcgacggcgtcatcgaccttcttgaaatgaaggcactgacctggcgtggagttaccccaattggtaccgaagctaccgttgaggagatcccagcagagctcgcagaccgcgcagctgagtaccgtgagaagcttctcgagaccgttgcagagtccgacgaagagctcatggagaagtacttcggtggcgaagagctcagcatcgctgagatcaaggcagctatccgtaagatggttgttaactctgagatctaccctgtttactgtggcaccgcctacaagaacaagggcatccagccactgctcgacgcagtcgttgacttcctgccttccccactggatctcggcgagaccaagggcactgacgttaaggatcctgagaaggttctgacccgtaagccttccgacgaagagccactgtctgcacttgcattcaagattgcagctcacccattcttcggtaagctgaccttcgttcgtctgtactccggcaaggttgagccaggcgagcaggttcttaactccaccaagaacaagaaggaacgcattggtaagctgttccagatgcacgccaacaaggaaaaccctgttgaggttgcacacgctggtaacatctacgcgttcatcggcctgaaggacaccaccaccggtgacaccctctgtgacgcaaacgctccaatcattcttgagtccatggacttcccggatccagttatccaggttgctattgagcctaagaccaagtctgaccaggagaagctcggcgtagctatccagaagcttgctgaagaagacccaaccttcaccgttcacttggacgatgagtccggccagaccgtcattggcggcatgggcgagctgcacctcgatgttcttgttgaccgcatgaagcgcgagttcaaggttgaggcaaacatcggtgacccacaggttgcttaccgtgagaccatccgtaagcctgttgagtccctcagctacacccacaagaagcagactggtggttccggtcagttcgctaaggtcatcatcaccattgagccttacgcacctgaggcagacgagcttgaagagggcgagtccgcaatctacaagttcgagaacgctgtcaccggtggtcgtgttccacgtgaatacatcccatccgttgacgctggtatccaggacgcaatgcagtacggcttcctggctggctacccactggttaacgtcaaggcaacccttgaagatggcgcttaccacgacgttgactcctctgaaatggccttcaagctcgccggttcccaggcgttcaaggaagctgttgcaaaggcaaagccagtcctcctcgagccaatcatgtccgttgaaatcaccactcctgaggagtacatgggtgaagtcatcggtgacgtgaactcccgccgtggccagatcgcttccatggatgaccgtgcaggcgccaagctggttaaggctaaggttccactgtctcagatgttcggttacgtcggtgaccttcgctctaagacccagggtcgtgcaaactactccatggtcttcgattcctacgctgaggtcccagccaacgttgccgcagatgttattgctgagcgcaacggcaccgcttcctaaagatcgtttagatccgaaggaaaacgtcgaaaagcaatttgcttttcgacgccccaccccgcgcgttttagcgtgtcagtaggcgcgtagggtaagtggggtagcggcttgttagatatcttgaaatcggctttcaacagcattgatttcgatgtatttagctggccgttaccctgcgaatgtccacagggtagctggtagtttgaaaatcaacgccgttgcccttaggattcagtaactggcacattttgtaatgcgctagatctgtgtgctcagtcttccaggctgcttatcacagtgaaagcaaaaccaattcgtggctgcgaaagtcgtagccaccacgaagtccaggaggacatacagtggcaaaggcgaagttcgagcgtaccaagccccacgtaaacatcggcaccatcggtcacgttgaccacggtaagaccaccaccaccgcggctatcaccaaggttctggctgacacttaccctgagctcaacgaggctttcgccttcgactccatcgataaggctcctgaggagaaggagcgtggcatcacgatcaacatctcccacgttgagtaccagactgaaaagcgccactacgcacacgttgacgctccaggccacgccgactacatcaagaacatgattaccggcgctgctcagatggacggcgcaatcctcgttgttgctgctaccgacggcccaatgcctcagacccgtgagcacgttcttcttgctcgccaggttggcgttccttacatcctcgttgctcttaacaagtgcgacatggttgaggatgaggaaatcatcgagctcgtcgagatggaagttcgtgaacttcttgctgagcaggactacgacgaagaggctccaattgttcacatctccgctctgaaggctcttgagggcgacgagaagtggggcaagcagatccttgagctcatgcaggcttgcgatgacaacatccctgacccagttcgtgagaccgacaagccattcctcatgcctatcgaggacatcttcaccatcaccggtcgtggcaccgttgttaccggtcgtgttgagcgcggtaccctgaacgtgaacgatgatgttgacatcatcggcatcaaggagaagtccacctccaccaccgttaccggtatcgagatgttccgtaagcttcttgactccgctgaggctggcgacaactgtggtctgcttctccgtggtatcaagcgcgaagatgttgagcgtggccaggttatcgttaagccaggcgcttacacccctcacaccgagttcgagggctctgtctacgttctgtccaaggatgaaggtggccgccacaccccattcttcgacaactaccgtcctcagttctacttccgcaccaccgacgttaccggtgttgtgaagcttccagagggcaccgagatggtcatgcctggcgacaacgtcgacatgtccgtcaccctgatccagcctgtcgctatggacgagggcctgcgtttcgctatccgcgaaggctcccgcaccgttggcgctggtcgtgtcaccaagatcatcaagtaatttgatgctctaactgttgaggtcttttagactttgactaactgacagcgatcccagaggaaatatcctctggggtcgctgttttgtcgtttctagggttggtttcggagttggtttgtctagtcggcgtcttaggttcgatttcacggtttcggtaccttgcgctcaatttgttaggggcgatctcagtcattttttggtggtcttcctagtggtcttgagattaagaagggggacctcctccgagatatgactgtataagttctacagttcgacttcgcgtatgctgacatctcatgctcaacttctcatcccacgacttcactaggaaatcctgacatcgccgactgaagtcgaccacgtgaagttgagcgtgggaactcgtgtgatgagaagtcgcccttaggaaatcgacttctaccaaaccacctccgaatctgcatcccatcactccggaactacaatcaggagttatgaaagatccatctagaattcccccagttgtggctcagttacagaaagtgtgggaggctcagccagatttagcgttgccgacacttttggggattttgggtaaccgtggcattgggtggggaagtactgatgaggatctggtcgaggcgctaaacacgatgtatacggagaacccgggcgagattcgtgggggttctagacttgcagatcctcaaagggaagttccggggcgttttcttgtggagactgaatctccggcttatcggattacagtggatccgtttcggatcagtgtacggagaatcgccaagggtccgcaccgacctttgcaacctggggtgtgggagtttcaggagattcgtcggtgtcggtcaggtgagcctttgttgattactgatgtggagggcattgatcatcggctgggtgtggttgttcggattacgctgctgaatgattctcctgctccaacgacgaaaagcctagacaaggtccgacgccgtgaagtgggggacaaggtgttttacttgcactttgagagcggggatactgctttgttgaatcatggtttagagatctaccaggcgtctaggcgcaccttggagcagcacagtgtgaaatgggatcaactcattactgctactccgggacaacttttgaagctgaaggaaaccggcagtgggaaaatccttgagcttggggtgttagagaagatcattccgttggaggggtagctacttaagctcctgcgcgagaccgactgaggggaacgacggtgggggttcctgtgacggggtctggggagatgatgcagggcaggccaaaaactccttgaaccatctcggcagttaagacttcctccggtgtgcccgtggcatgtacgtgcccatctttcatcacgatgaggtggtcggcgtagcgggcggcttggttgagatcgtgaagcacagtgaccacagttttcccggcctcgttgaatgcgcgcagcaattccaagagttcgtattggtgggcgatgtcgaggaaggtggtgggctcgtcgagaagcatgatcggtgtttgctgggcgagcaacatggccacccacactcgttggcgctggccaccggagagttcatcgacgaggcgagctgcaagttcggtgagattcgtggaggcgagcgcttgcgcgacggcgtcttcgtcggaggtgcgccattgttgtatgaggctttggtagggagcgcgcccgcgcgcgatgagatcgtaaacccggatgccttctggggcgatggaggtctgtggcagcaggcctagttctcgggcgatctctttaggcttgaatgaatcgagttgccgaccgtcgagaagcactttgccgtgctgcggattgagcacgcgggagaaaccgcggagcagggtggatttgccgcagccgttggggccgatgatggcggtgaaggtgttgtcggggatggtgacgttgaggtgttcggcgatgacgcggttgtcatacgccatggtgacgtcttccatggtcaggcggttattcatgagggatccttaaaagaactatcggatggtgccggtgcggtattggcggcgggtttcgcgcagcagaagccagatcatgtagcaaccaccgatggatacagtcaacaggccaaccgggatggtgcggtagaaggagctgataatcagggaaaggaggtgagcgcagctgagcagtgcggaacccattgcagcggcagcaaccaggctgacaccaggggttttagtgaggcgacgtgccagctgtggggcaaccaacgcgatgaaggagatcggtccggcagctgctgtaaccaacgcggaggtagcaacgccgacaacgatgagtgccaagcgggtggagtttgttttcacaccgagggtggtggctacgtcatcgcccatttccatgaaacgcagtgaccttgccagcacaatggcggccacgatgatgacagcagcgatcaccagagaggggagcagagattgccaggtaatgcggttgatggaaccggcactccagaagcccacaaccatggcgtcttccacatcggcgcgggtgattagatacgcgttaacggaactgagcatggccgagacaccgatgcccacgatgatcaagcggaaaccttgcacacctttacgccacgccaggacatacacggcaaaggcggtaacaatgccaccgacgatggcagcgaaagcgatgctccagtagtgagtgttgccgaggaccaaaatgacaagaaccaccgccgtgtaagaacctgcatcgaaaccaatcacgtcaggtgaacccaacgggtttcgagtaatcgactggaaaatcgctccacctatgccaagcagcgcgccgaagacaacagcagcaatggctacaggtagacgccattcccgcaccaccaacaactggaatttctcgccggtgccagcaagtgcattaatcacctgccccaaagacagtgggtaatcgcccatcgtgatagcccatgtggcgctgcatagcgcgatggcgaaaaggataaggctaaccaccatgaggcgggctgggatgcggaaagagaaccggcgcctctgcactgaaactgcgtggtagccggggttaagcgcagggcttgtcgaagcttcagacacaggtctagtggattccaccggctcagacgcagcaacaggagtttcatcagttctagatttgatattaaagaccactggctttcctccgtcgaactagtgcgatcaggacaggtgcgccgatgactgcggtaacaatgcctacttcaatttcgccggggcgggcgatgatgcgtcccaaaatgtctgcgccgagtacaagaacaggggcgcacagggcgctgaaggtgatgatccatcgttgatcggggccaactacccagcgcacaacgtggggaaccataaggcctacgaagccgataccaccagtaagggcggtcgcgccgccggccaacaaggtgactgaaatgatgccgagcacgcgggtgcgcatcactttggtgcccagggatgcagcaaggtcatcgccaagcgcaatggagttcagtgctcccgacagcaggagcgcgatggccagtccgactgccaggaatggcaatacggtcatggtgtcgctgaggtcggtgcgtgcaacagaaccaagattccaattgcggatgctttcaaaagtctcaggatcaatcagtgtgaggaagctcgtgacgccaccaagcacggcggccagagcaacgccggcgaggaccagagcaacaggattaacgctgccgctggtgctcgcaccaatgaaatacaccagcagggtagcggcggcagcgcccaggaatgcgaaccagatgtagcccgtcacgctgctgagtccgaaaaatccgacacctacggtcactgcgaaacctgcacccgcgttaactcccaaaattccgggatcggcaagcgggttgcgcgtcagcgcttgaattaaagcacccgccacaccaaaagcagcgccagtcacgatgcccaccagcgtgcgcggaatacgcattgaccacacgataatcgacgcctcagagctgtcgtgtgcggtaaaaccctgccatacggagctaaaagaaagtgggttcgcacccacagcaatacttaaaacaataagcgcacccagtgccacgacgattccgagaatgcccagcgctcggcgcctgccgaggtttttgcttatcgacgtctccttctgcttctctaccgccaccgccgtcatatcgcgtgactcctaaagatcgagggggaaagaaaagtatgagacatcgaaagtccttaaaactagctgaaactaaaacgcttagaacatcttaggtgagcctttactaaatgaaaatcccccgtgctataagtttcatgggactatagggaaatctttaggaaaaccgattgctaaacgtatgaatttttagcgcttcagaggagttggagcagtttggggatcttaaaggcgacttcacgtgcgctgacttctcgtgctcaatttcacaccacacgacatcactggaaaaacctgacatcgccggctgatatatatggaaatatcaactccacccacgttgcgggtacgcgcgtgatgaatggtatcggcggctcgggcgatttcacgcgtaacgcctttgcttccacatttatctctccctcggcagccaaagttgatgcgatttccgcgattgtgcctttcgcgtcccatatcgatcacacggaacatgatgcgatggttgtcattactgaatatggctacgcagacctgcgcgggctatcgccaaaacaacgagtccccaaaatgattgccatcgcccacccggactatcgaccactgctggaagcatactttgaccgggcgctgaacagtgctgattcctatcagcacaccctgcatgatctgcgcaccgccttcgatttccataatcgcttgaactcacaaggaaccatgaaaatcgaaaaagcatagtgcttttcgacgagccctccaccttcgccgccaccagagtgccggcggtcaaggtgggtgggctatttcagtgcggggcagtgaaagtaaaaacgcaactttcttacagaacagggttgtctttcagacgactatgtggttaactacttgggctgctttaacacggcgtgaattaaccatgccagttggtaaggcaaacatgacaccttcaattggagtcgaggcgcatgaaaatgcacttcaacttcagggggtatccactgaagccgggtgactggtgaaggcggaaccggagaaggggcatggcaaataaacagcggcagttacgttagggcctagatcacgcattttggtcccttccgatttccctgacttcattgttgggttcatcgtggagcgttttatttgtacagcgcccgtgatccaatgtcagaagcatttgacaggtcaggttaaacactggcgttgcgcccgagccccaagcccggacaacgttatagagaaagaatgaagcgaattcccaccgcttttccaaaatggaagatgtgggacgagcgaggaagaggataagcgtggcgggacaaaagatccgcattaggctcaaggcctacgaccacgaagcgattgatgcgtctgcacgcaagatcgttgagacggtcacccgtacgggtgcccgagtcgttggaccggtgcctttgcctaccgaaaagaacgtatacgccgttattcgttctccacataagtacaaggactctcgcgagcacttcgagatgcgcactcacaagcgcctgatcgacatcctcgacccgacgccgaagactgttgatgcccttatgcgcatcgaccttccggccagcgtcgacgtgaacattcagtgatcgacggaatttttggcagcggagaataaataatgagtgaaaacgagatcaagggcattctgggcaccaagctcggcatgactcagatcttcgacgaggagaaccgcgttattccggttaccgtcgttgaagcgggtccatgcgtagtttcccagattcgcaccgttgagaccgatggctacaacgccatccagatcgcctacggcgaaatcgacccacgcaaggtgaaccagccattgactggtcacttcaagaaagcaggcgttaccccccgccgccacgtcaccgagattcgtatggacgatgtctccggttacgaggttggacaggacgttaccgttgaaatcttcaacgacatcaagttcgttgacgtcaccggtaccaccaagggtaagggctacgccggcgctatgaagcgccatggcttcgctggccagggtgccggccacggtaaccaggctgcacaccgccgcgtaggtggcattggtgcagctgctaccccaggtcgcatcttcaagggcaagcgtatggctggccgcatgggtaatgaccgcgtcaccacccagaacctcaaggttcagaagattgacgccgatgccaacatcatccttatcaagggcgcaatccctggtaaccgtggtggcatcgttaccgttaagaccgcagtgaagggcggtgcacacgcatgacgaatctgaagctggatgttcagaccgctgatggaaacatcaacggatctgtagaactccctgcagagatttttgaccgtgaggtctccgtcgcactgctgcaccaggttgtcaacgcacagcttgcagcagctcgacagggcacccactccaccaagacccgtggcgaagtacgtggcggtggccgtaagccattccgtcagaagggaaccggtcgcgctcgtcagggctcgatccgcgcacctcacttcaccggtggtggcatctcccacggccctaagccacgcgactactctcagcgcacccctaagaagatgatcaaggctgcactttacggtgcactgtctgatcgtgcacgcaatgcacgtatccacgtcgtctccgaattggtgcctggccagaccccttcgaccaagtctgcaaaggctttcatcgagcgtctgaccgagcgtaagtccgtgctgctcgtagtgagccgtgaggatatcaacgcccagaagagtgctaacaacctgcctggcgtccacatcctggccgctgatcagctgaacacctacgacgttctcaagtctgacgacgttgtgttctccgttgaggctctccacaccttcatcaaccgcgcttccggtgcggcacaggaggagcagaactaatggctactatcgccaacccacgcgacatcatcatcgcaccggtcgtttctgagaagtcctacggcctcatggagcagaacgtttacacgttcttcgtctccactgacgctaacaagactcagatcaagattgccatcgaagagatcttcggcgtcaaggttgcatctgtgaacaccgttaaccgtgcaggtaagcgcaagcgctcccgcaccggcttcggtactcgcaaggctaccaagcgcgcttatgtgactcttcgcgaaggcagcgactccatcgacatcttcaacggctccgtcgcttaagacgtcgatagaaaaggacacattatggctattcgtaagtacaagccgacaaccccgggtcgccgcgcaagctccgtttccatgttcacggagatcacccgttcgacccctgagaagtcacttctccgcccactgagcaagaccggcggacgtaactctcacggccacatcaccacccgtcaccgcggtggtggacacaagcgccgctaccgcgtcatcgacttccgtcgtaacgacaaggatggcgtattggcgaaggtcgctcacatcgagtacgacccaaaccgtaccgctaacattgcactgcttcactacttcgatggcgagaagcgttacatcctcgcaccgaagggcctgacccagggcaccgttatcgagtccggcgctgcagccgacatcaaggttggtaacaacctgccactgcgtaacatcccgactggtaccaccatccacaacgtggagttgaagccaggcgcaggtgcaaagctggcacgttccgctggagcttccatccagcttcttggtaaggaaggctcctacgcagttctgcgtatgccatcctccgagatccgacgcgtagacatccgctgccgcgcgactgttggtgaggtcggcaacgccgagcagatcaacattcgttggggtaaagctggtcgtatgcgttggaagggctggcgcccaaccgtccgtggtgtcgttatgaacccggtcgaccacccacacggtggtggtgaaggtaagacttctggtggtcgccacccagtctccccatggggacagaaggaaggccgcacccgcaagcctaagcgttacagcgatgacatgatcgttcgtcgccgtcgtgctaacaagaacaagaagcgctaagaggaggtaacgaagaatgccacgcagccttaaaaagggtcctttcgtcgatgagcacctcctcaacaaggtagatgctcagaacgaaaagggaaccaagcaggtcatcaagacctggtcccgccgttccaccattctccccgatttcatcggtcacacctttgctgtccatgatggacgcaagcatgtgccagttttcgtggacgatgccatggttggccacaagctgggcgaattcgcccctaccaagaccttcaagggtcacgtcaaggacgacaagaagggacgtcgataagcgatgagtgacaacatcacctccgcaagcgcgactgctcgcttcgtccgcgtcagcccaatgaaggcacgtcgcgtcattgatcttgttcgcggcaagaccgtcgttgaagcactgtcaatcctgaagtatgcgccacaggcagcatctgagcctgtagcaaaggttgttgcatctgcagcagctaacgctgagaacaacttcggcctggatccacgcaccctggttatctccgaggcttacgccaacgaaggtccaaccatgaagcgcttccagccacgtgctcagggacgcgcattccagatccgtaagcgcagcagccacatcaccgtggtcgttgagagccagaaggaaggagccaactagtgggccagaagatccatccacacggcctccgtttgggcatcacttccgactggaagtcccattggtacgccgacaagtcttacgctgactacgtcgcagaagacatcaagattcgcgaattcctgtccaagggcctcgaccgtgccggcatcgccgacgtcgtcatcgagcgcacccgcgaccgcgttcgcgtagacatccacaccgctcgcccaggcatcgtcattggtcgtcgtggcgctgaggctgaccgcatccgccgtgagctcgagaagctcaccggcaagcaggttgccctcaacatcctcgaggtcaagaacgtcgatgctaacgctaagctggtggcacagtccatcgctgagcagctgaccaaccgcgtggcattccgtcgcgcaatgcgcaaggctatccagtctgcaatgcgtcagccacaggttaagggcatcaaggtcgtgtgctccggtcgtctcggcggtgccgagatgtcccgcaccgagcgctaccacgaaggtcgcgttccactgcacacccttcgcgcagaaatcgattacggcacctacgaggctcacaccactttcggacgcatcggcgtcaaggtgtggatctacaagggtgacgtcgttggtggacgtcgcgagagcgagatcaatgcacccgcagagcgtcgcggccgcggcgaccgcaacgcacgtccgcgtcgtggtggccagcgtcgtcagcgtgctgagcagaagcaggagggctaaacatgcttattcctaagcgcgttaagtaccgtcgccagcaccgtcctacccgtagtggtatctccaagggcggcaaccgcgtcactttcggtgagtacggcatccaggctctcgagcctgcctacatcaccaaccgtcagattgaatctgcacgtattgcaatcaaccgccacgtcaagcgtggtggcaaggtttggatcaacatcttcccagaccgcccactgacccagaagccactcggcgttcgtatgggttccggtaagggccctgtggagaagtgggttgcaaacatcaagccgggccgtatcctcttcgagatgagctacccggacgaagctactgctctcgaggctctgcgccgcgctggccagaagcttccatgcaaggtccgtatcgtcaagagggaggatcagctctaatggctatcggtaccccagcacacgagttccgtgagctcaacgaggaagaactggttacccgcctcaacgaggctaaggaagaactgttcaaccttcgcttccagcttgccaccggccagctgaccaacaaccgccgcctgcgcaccgtcaagcgcgacatcgcccgcatctacaccgttattcgcgagcgtgagctgggcttgtctgtggttccgggagctgaggcttaatcatgagtgaggcaaacgtgaacaaccaggaaaagagcacccgcaaggtccgcactggctacgtggtttctgacaagatgcagaagaccatcgttgtcgaggtcgaagaccgcaagcagcacgctctctacggcaagatccttcgctccgcgaagaaggtcaaggctcatgatgaggagcagatcgccggaatcggtgacttggttcgcatcgaagagacccgcccattgtccaaggacaagaactaccgtctgatcgagatcgtcgaaaaggctaagtagtttgggcgtcatctactgatgacctctagctattcgcttcaagcgaatgcgtaacacccctggtggaatttccttttgggaatccaccaggggtgtttctttgtctttataacagccaagtactagaagccgaagacgaagaatccagctgtcagccaaatggtgggggacagcagggcgaggattgcgcagatacccaagacccaactcttggacttgaaagcggtaaacaatgcatatccaatgagtggaacggcaatgatcgggtagatccactcacggatgccgtaccaggaaatcgggacgagccacaggacatatccgaggattgcgacaactagaacgctaagccatgcaaaaattgaaacagttttttggttttcatgagccatccgaatgttcctaatagaaggggcatggagatttaaccaccaacgtatcaagagtttttagatggggctacagcagatatagacgcatgtgagtatcgatgtgttctgggagatcgccgcgtcctgaaagaacgccgttgtcaacgaagaagttaaaggtgaaatagtccgtaacaccttcggcagtagatcggccggcatgtccgtaaacaacttggatttctgaatctgacactctggtgacggattccacggtcttcatttcaaaaggagcaggacgagcaaccatatggccgtcgataaacagcaccaccacgtcggcgatcgcagcacccgttccagtagaacgttcggcgtctccattggaaccgttgagaaccacatagctgagcttggaacaggaatcgtagccgttgtcgcccatttggaagtgatagaaccagtcaggaacctgcacgacggaatctgcagatccagctagctcaccaaccggggtgcgagattgtgcaagatatggcccaaaatccgaggtacggggatccaaattgcattgcactggtgcagtagtggaggcttctgtagcactttgcacagtcgttctagtggtgggttctgctgcggcggtggaagtgagtgtggcagttaccgtggtgacattctccgtggatgtatcagtggagcgctcatcaagggaaacacacccgcttagcacggctgtgagtagtactgtgctgcttccgagggcgagattcttgcgtagggacatgccatgtacctcctaaactaggcgactacttatgctgggaaaacaagctgattaatatatcgcgaatcacaccgatattgttccttattaacgcgcaacacggatttgaattcgggggtaggggtgtggttagatatacaggttgtctgtgtaggtcggactcgcggtgcttttccgagtcgcgtttccgagacccctcgacgaggccgtaaaacgccaagcgttcgttgcccacattcgtggagtatgtagacatctgtagtacaaagaccacgcgtgtttgggacggaaatccagcacgcattaatccaggtcaggagaccagtagtgattcagcaggaatcgcgtctgaaggtcgccgacaacactggtgcacgtgaaattctgtgcatccgcgttctcggtggatccacccgacgttttgctggcattggtgacgtcatcgtcgccactgtcaaggaagcaaccccaggcggcaacgtaaagtctggcgaaatcgtcaaggctgttatcgttcgcaccaagaaggagacccgtcgtgcagacggttcttacatctccttcgatgagaacgctgccgtcatcatcaagaacgacaacgagccacgtggcacccgtatcttcggaccagttgctcgtgaacttcgtgagaagaagttcatgaagatcgtttctctcgcaccggaggtgatttaagaatgaaggtccacaagggcgatatggttctggtcatctcaggtccagacaagggtgctaagggacaggtcatcgcggctttccctaagaccgaaaaggttctcgtcgaaggcgttaaccgcatcaagaagcacgtagctaactccgcaccagagcgtggcgcagagtccggcggaatcgtgacccaggaagctccgatccatgtctctaacgtcatggtcatcgactccgacggaaacccaactcgcgttggctaccgtttcgatgaaaacggcaagaaggtccgcgtttctcgtcgcaatgggaaggatatctaatgactgagaattacatccctcgtctgaagacccgttaccaggacgaaatccgcaccaagcttcagggcgagttcgagttcgaaaacgtcatgcagatcccaggcgtcaccaagattgtcgtcaacatgggtgtcggcgacgcagctcgtgactccaagctcatcaacggcgctatcgaggacctcaccgcaatcaccggtcagaagccacagcttcgccgtgcgaagaagtccatcgctaacttcaagctccgtgaaggcatgccaatcggcgcaaaggttaccctgcgcggcgaccgcatgtgggagttcctggaccgtctgctgaccgtggcactgccacgtatccgcgacttccgtggactttccgaccagcagttcgacggccacggtaactacaccttcggcctcaccgagcagaccatgttctacgaaatcgacgtcgacaagatcgaccgtcctcgtggtatggacatcaccgttgttaccaccgctgtaaccgacgatgaaggtcgctccctgctccgcgagctcggcttcccattcaagggtgaagacggcaaccgccagcagtaaactgcatagttaaaagcacttaccttaactggtaggtgcttttttcatgtctacgcagtgggtaactttcagaggaaaattacccaaccaaaacaaaggaactttcatgaacgtgcaacgcaaactgctggcgatcgtaggggctttcatggcagggtctttagccttgggaacaccaactgcacaggcccaaagcattggcagcagtgcctcacagagaactgaagtcttacgtgggctgacctcatctgccggaataccagatgccacagcgccggaaggcggggcaaaagtcgtggtctttggagattcacatgcatcaggaaccaatgcaccatttgatgtggatgaacgcggctgcctcaaggggaaccaatcgtggcctgatcaattgcaagcacaacaaggattgcagcagggggagctcattgacctttcctgcaacggcgcctccatcaactcgacgggtttccacttttccgatgaagttcggcatgcagaagcactaggggccattggaccaaataccgagaacatcttcatccaatttggcaagaatgatcagtggggacactcaccaatcaatttgcgctattccgtgatcaactgcctttttgatgcggccaacggatgcggtgagaaagctgtagcggctggaaccatgcaggatccctcctcggtcaccggcgaaaactatgctcagcggatgaaacctgtcatcgactacctcaagtactacgctccaaatgcgcagatcacgttgctgggataccaggaatacaccccacgaagcggaagcgagatttgtgtccgcgtgggaggtacggaactaaggaaaccagacgccaccaacctggtgtcctatatgaacaatcttgagtcggccatttttgaagcctctgagattcttgacgtccagcatgccaatctccgtgaggccactgcaggacacagcagctgctcagctgaaccgtgggtcaacggagtgctggatatgcgggtaaacgctgtaggaggcacctggcacccatctccaaagggagatgaagtgaccgcgggcctcctcggaaccttgatgtaactatctagaattcttcatagacggctggatcttgatctttgatccggccgtttttgcgcgccaaagcggtaatcgcctggacgtcttcgtcgataagcgaaatctttaccgcctccaagttgctgcgctgcctggccgggttggtggagcgtggaatcggaacgattcccctggcgtgatgccaagcgagggcgatttcgccgctgccgaccccgtagcgctcgccgatttccttgagcaatggctcttcgacgagtccgcgaccgttgctgagcgggctccaggcctcggtaatgatgcccagctcatcgtggaaatctacctgctccacctgcgggaaataggggtgcaactcgatctggttaacggccggcagttcaccggtttcgcggcgcaggcgatcaatgtgatttggaaggaagttagacactccgatgtgcttgaccaggccagcatcgcggacttcaatcagcgtttcccacgcctcgacgtagagatccttgctgggattaggccagtgaatcaagaggagatcgatgtaatctaagttgaggcggtatagactttcctcaatgcggacgcgtcctagatcgcgagcatggaagcggccagggagcttactggtaacaatcaattcctcgcgggggacacccgactcgcggacagccttgcccacggtaccttcattttcatagttgtacgcggtgtcgatgaggcggtaaccagcatcaatggcagtagcgatggcttcaacgccaggtgcgccatcaagatgaacggtgccgaaaccaattggaggaagggaaagagtcatgtacgccaggttagcgaaacttcagggaaggggatcggtaaggaattgaaggttaggcctcgaggaggaaaagaattcaaaaaggcagccgatacgcaggtctccaggtacttgaccatgctcatactttcgctgatctacagccgaccaggtgtagatctctaggaagtaaaaccactcttcaagggcattccacagacagtcttggatttgtttgtgcgagaggtcttcccagttgtttggaaacgataaagtgacccccggatagtggaaagcacccggctggtgggcgagaagatcgttgattaatgaatcaaaattgatgatcaatggcatgacgaaatcttggtcgtcataactgaaactgaaatcagggaacagccaccttttcggggagaacttcattgcctgaccgacagacatatccctgttctctgcagctgacacgaaccactgcgggaaaatcctctccagctcttcgcgtgcttgattcggctgttctacctgttctggcattatccgagctcgcccgcatagtggttaaacttgttgccccgaacaaaaccagcaaggaaaatacctgaatcctgcgccgcctcgattgccagcgatgttgcagcaccaacagcgattacacccgaaattccagccatggcagccttttggacaagctcaaaagacgccctagaactcatcaccaaaatagtgttttccaaggggagctttcccgccatcagcatgtttcctataactttgtcagctgcgttatgccgaccgacatcctctcgaataatcaacatctcaccatcaagcgtggccaaaccagcagcatgaaccccaccagttttgtcgaaaatcttctgcttcgacttcaacttatctggcaacgacacaatcatccgaggatccggtgtaatcggcgtaatgggccagcccttcttgttcatcaactgctcaatagacgtcgtgccacaaacaccacaagcagacgtagtcagcacattgcgttgggctgccacgaggtttagttcgcgtaccggttggaaagttgggatgtggagtgcttcgtgttggctgccttcgggattatgggagggattctggacgggatcccgggccggattgtctttggggatgacatcaagttctaagacgttgtacgtattttgattatctgggccaacagctcctgcacaatagcgggcggtaaaaacctcagaagcatccgtgatcagaccttctgacaagaggaggccatgcaccaactcaatatcatggccgggcgtgcgcatagtggtggtaagcgcagtgccattaacccgaatttctagaggctcctccaccgcaacagtatccggacgagtgttaacaaaaacttgctcgtcagtggacacaacgcgtgggacctgcaagttttgggtaatccgacccatttttatttagcctccgggtaatttttagcgatgatttcttgaagatgcagagcattaaccaacgtggactcggcccaatcatcagtgcttgttccagaacggccagcagctaaaccaagaaggaaagacgtcattggtgccgctggtcgagaagggccatgcgcaacatcacgcgtgagattcaacaggtgggggacaacctctgcgagaatgtctggatcaatatccagctctgtgcacacagtgtcgagccattgatacattttctgcatcttctcggcttcgttgtttttgcttggggtggtgtccacagtgaaactcgtttctgatgatggctgcaattgtaaaactgcaattataaataagcccgcatcctcgtttatttaaacaaggaagcgggcgcggaaaattccctggtgtttttctaagaagcagtacgtcctgttgcttcaaggcgaaccacaactgacttggacactggagtgttggatttttcagctactgaatccaatggaaccaatacgttggcctcagggaaatacgtggtgacgcagtccctcgcggtgtcatattccaccactcggaaattcggtgctcggcgttcgccatcatcaaagacagagacgatatcgacgatgtctccatccttgagaccacgttgcttacaatcttgaggattgacgaacactacgcggcgaccattgcgaacaccgcggtagcggtcatccagaccgtaaatcgtggagttgtattgatcatgtgaacgtaccgtgttcataagcaaatagtccttgggtagctcaatcacattggtttcattaaccgtcaattgggccttgccattggatgtgttgaagatgcgctcacgaggtccgttggggaggaggaatccaccggggttgtcgatgcgacggttgaaatcgtggaacccaggaatggtggcctcgatgtgatcgcggaccacatcgtagttatcaatcatcggctgccagaaggcatcaccgaaggtctgcttaccgatggttccaatgatgtcgcattcggacttcaaattcagatccttgttggcggttcgtttaccagtggatgcgtgaacagcgccggcagaatcctcaactgtcacacgctggacgcctgacttttggacatccttatctgttcgagcaatcaccggaaggataagtgactgctcaccaggccatgcttgtgaaccattgggcttggtcgacagatgcaccgtcagctcattggattccatgcccttttcgacaacagacgtatctgaggacactcgaacaaggttgccaccgagggagagaaagaacttggtcttgccttcgcgcatggctcgcagggaatttaccgtgtcgaagccgtgcttgcggggcacatcgaaaccaaactcgttttcaagagcagcaaggaatgcctccggcattttctcccaaatacccatggttcgatcaccctggacgtttgagtgcccacgaagcggggcagtgcctgcgccaggcttaccaatatttccagtaagcagcaggaagttcaccatttcacggatggtgtacacagcgttcttatgctgggtgaccccgagagtccatgacaccaccacggtgtcagacttttccaccatgtcagcggccttgttgatctccgctgccgtcagaccgcatcccttgagcagaacctcatcatcgagtgatttgaggtgctcgatggtttcatccacacctgaacagaatttatccaagaatgcatgatctagggcatctctacggatgagttccttgttgagcgcctggaagaatgcgcggtctccatcaagacggatctgcaagtattcatcagcaagtttgtctgaaatgctcaacgcgcccttgactgattggggctcacggaatttcatcagaccggtctctggcatggggttcagcgccagaatcttgccaccgttttccttcaattctttgaaagccgtcaacgcacgtgggtggttggtgcccgggttttgtcccacggaaatcaacaaatcagtgttgtagaaatcctccatcaccacggatcccttgcccaaacccaaggtctcacccaaggcagtaccggtggactcgtggcacatgtttccacagtctggaagattatttgtgccaagtcggcgggctagaagctgcagcatataagccggctcattgggtgctcgaccagaggtgtaaaacaccgcttcatctggctcgatctcgcggagcttcgacgcaatgatcgcaaatgcacgatcccaagaaatagggcggtagtgatcatcgccagaagaacgatcataaaacatgggctcggtgattcggccacgctttcccagccagtgatcggtcttttcccgcagatcataaatagaatgctctgcccagaactctttgccggcacgatcaggtgttgtttcctcggcgaccgccttggcaccgttctcgcagaactcaaccacaccaaggttggcagtggaaggctcaggccaagcacaaccaggacagtcgatgccgcctggtttattcatggtgagcaacggcagcagggcacgattcggaacagcatgctggagcgcatgcaaaacgcctggcacaccagcagcagaagtaatgcgccgtcccacatccggatcatcaaattcattcgcggtgggattcacgttcgaaatctcagttggaggggttgtcataggtcacagtctagacccggcaattgaacccatgccgaaaaatgaattcttcaatctatatgggggtatgtggaaaacctaaaatcaagaggactcccagcacatgcgataaaatctcacatgtcgtttgatactgcaaagtaccgaatcgcactgttagtttttcaagggaagccggttaacaatccggcgctgacccgcaaccgtagatcaccttcgcctggagttttcacgcaaaggggacaagccggattacttggaaaactgacattgacttagaacctttttgtcgtggactacgaaaagcttgcatcttcaaattctgcgcacaaagtgttctaagacgacgtctgcccatcggcgctctaatgcacattacagcgtttacagaattgaaaatgaaaggttcaaagccttgaccattacttttagccgcgttgctctgaccaccctggcagtcaccgcaaccactttgtccctgagcactgctgcgaatgcacagtcttccttgttggataagactcttgatgcccgtcagtgcatcgatgcagacaacgtctgggtctcagttgactatggtgcagattccgaaaaagaaccagagggcgcatgtgccaccgagttcactgatggtgttgtagctcttgaatctgctgggttcaaactgacctttgacgaatctgaaatgggcaaatacatgaccggtatcaacggagttgttcctgattgggttgaaactggaacttactggagttactactctggtgaagtcgcagatgattacagcgtggactacacctactacgaggttggtgcatctaattctgaacctgaaggtggaactgttgaggcttgggttgttggcaccggcgaggaaacaccagcactcgagactcttcctgaaactccagcagcaaccggatcttctgaagacggcggctggattgcagtcatcgcaggtcttctcgcactgatcggtggtggagttgcagctttgtaccagggcttgatcactatcccaggtctggttctgcctaagttttaagcaacctaacctaaagcttcaaacaagagtgcccaccgacccttcaagatcggtgggcactttaggtttgctccacgaagcaagccaacaaaatctttagacccgaggcaccccggcctccccgaagtcacgctcgacgccgaaagcggcgcggcggctggcgcgtcgtaaagcacctaaaacgggtttggctgtgagcagtaatagcactgaggtgaagaaggcgcggccgagatcccaacccatggatgtggtgaggcagaacagcatgaaggtgtggaggttttccaggacgggcgcgccgggtgtgaaggaaagcccgctggtgacaccgatggcgtagggccagaagctcatgttcatcatggttccgtagccgagtgaagagacgatggcgtataggacgatgatgagcatttcctttttgccgcgtacttgggggagtaggccggcgccgaagctgacccaggcggctgcgagcatttggtaggggagccacggtccgattcctgcggtgagcagcgcggatgcgaacagtccggtgttgccgaggatgaatccgaagccgggtccgaaggctcgtccgccgaggatgaggacaaagaagactgcttcaaagcctgctgcgccggcaccgaatggtcggactacggcaaccatggcggtgaggacgccgagcatggctacggctttaacgtcgaatccgttttcactgatttcggcgatgacagcggccagcacgaggggaatgacgatcgcgatgtagaggggcgcttgggctttgtcggacaggaaggattccgggttgacgatcagcggccagaagaaaatcacgatgctcaaaaccgcaaggaagcttaaggtgaggaaggttttgggcttgagtgtgatggcgttgatcatgagatttcaccatgccctagcgcagctttcacggccgagactgtgagccagtgtgattcctcttggatgccggcggtgatttttgcgacttgtggggcgtaagccggtgatgcggggaggatttctacggctgtgccatcggagatgatctttccagaggccataaacaacactcggtcggcgcacagtgcagagaattccacgtcgtgggtgaccaccaaaatggcgtggccgtcgtctgcgagttgttggaaggagcgggcgagggatttcttgccgtcgtagtctaggccgcgggtgggttcgtcgaaaaataccacgcggggttttgcggcgagttggatggacagcgcgagggagagcttttggccttctgatagatcacgtgggtggagatggtccgggatattcgggaccagtgaatccaggatttcccgcgtggtgccggcgggtgctgcggcatctttatcagagcgtgcgagctctgcatgcacggttgattcatacaaaatatcggtcggtgtttgcggaaccatggacacaagattgcgccgcttggcgggctttaaagttttggggtctgtccacgaaaatcccgcggcctcatcaagcacctgcaccgagccctgatttctagtccctgaaccttgtaaagcccacagcagggatgattttccgcagccgtttcggcccatgagcacggtaatttcaccggagttgagattcaagttcacgccgtcaacggcacggatttcggggaaatcaaccatgatatcttcggcgatcaaaagtggctggacagcgtggttgtgtaatttgttcaccactaaaccacgctgatacaggcgtttgcgcatgtcagcggagtgtgcgcgtgcatcgcggatcgatagcggtaggggagcccagccagcccagcgtcctaattccacaatgggtggtgccacatcagaatcagccatgatttcttccggcgtcccaacagtgacgtgcccatcagcgcccacatgcgccacgcggtccacgtactgcagtacgcgctcgatgcggtgttcagcaagcactacggtcatcgccaagtcatgagccagcttggttacggttgccagcacatcctcggcaccattagggtccaaagcgctggttggttcatccaagataatcagcgcggggcgagtggtcagcaccgcgccaatcgccacgcgctgctgctcaccaccagatagttccgccaatggcacgtatcgcagctccgcgatgcctaaaagatcaagggtttcctctacgcgcttgcgcatgaccgcaggtgggagccctaattgctccatgctgtaggcaagttcttcttcaaccgtgttggtgataaaacttgccgccggatcttgcccaacgacgccgaccacgtcggaaagcatgcgtggtgggaaatcacgcgtatcccggccgaccacgcgcacgcgcccatcaagtcggccgccggtcgcatgcggcatcgcgccggacatcgcgttcagcagcgtcgatttgccggagccggtgcgccccacaaccagcaggatttcgccttcaaaaagcgtcagattcacgtcgctgatctgcggcgccgccagcgtgcgctcatcgtcataatacgaggcagcgacgctttccagttccagcacggggtccgtcgaccacgcagtgcgcgcgctaaaaggagcactcattaaacttcggccctttctgggctatttattgcttttcgacgcttgaccctcactttgttcttcggcaagcggggcgtcaagaatcctggcatcgtcgccacaacaagtcctgccacaacgagcaacggaacggtgtctggcatatgcaaaggaacccaggtggtgatcatggaacctggatcaaggtatcgtgtcagcgcagccatgagcagcggaatcacacctgtgatgcacacaagccattccgcagcaccccaaggcaactgatcaaaagtggtggatgtttttctatgtgaagcaacgaccaacgaaatgatcaagaagcccacgccggtaataaacaccggaacggcaacgaacatcggtgatgatgcatctaagaccacaaacagaccaacggtcacgccgagtattccgaatgcaccaaaaatagaggtcacacgctgttggaatttggatacatgagcctgcctgccataaccacgggcatccatggaattagccagggccaaagacctatccaaagtgtcctggaaaaccggcatcaaaatccgcgcgaaaccacgaacacctttggcatcatcaccacgcaaggttcgtgcacgattaatgcggaacgccgactcagccatctgaggtgcaatggaaataccgatgaccaccgcagttcccagttcgcccaatgcgccaggcaacgatttgagcagcttcttgggatccgccaaagagttcgcagcacccaccgccacgatcatcgttccaagcgttaagccttgcgtcgtcgcgatgatcagaccctcgagatacaccgtgccaaacacgtggatacccgcagcccattccggcaactgcaccggcgggatccgaaacagttcaatggtgccaatttttgctcccaccacaatgtgcatgaccaaccggtacaccacgagccaacccgcgatcatcaaatagatcgggaaagcacgcgaccacggcgatgacccacgacggttaaacaccacaaaacacaacgtggcaaaagtgagcgccaaaatataaggattgttggtcatgctggcacaaccagcaatacccaacgcccacacccaccacgcccagggatgaaccatccgccgggacagcacatatcgctcaatccatttcacgaagctttaaccctggacctctgaacgacgaatcgcccacgccgccacagcagacgctgaaaccaaggaaatgacagccagtgtgagtccaatgatccatccctgagcagaagaatccaccgtgcctgtggcgtacgtctgctgcgtcgaaccctcagccatgacgtctccatcttggcccgcaggcgccataagaacctgcgtggtcatcggatcaacttcaggagcttctgccaccgctgttgcctgcggttggctatttgcttcaccagccccagctggggcttggacagcagcagtggtcttagcggctgctgcagcaaccaagttctcgtactgacctttagtaatcgagtttccttcagaatcctgatacaccaatacctcattagggttctcagggtttacctcagcagtgggttcagctgcttgtcctcttgccgaaccagctccagcccctgcgataggagcttcagtagtttcagtgggctcttcgtcaccccctaaatcggcgataggggactcggaggttggggttgtggtgatgaaatcatttggatcaaaatcaattttgtaatccggatccgcggagtctaaccccaactccgcctgagatttactcaccgggatcgcgccgggacgatcagtatctccccaataccacgcttcaacagtgccgggtttggggtagtagaggaaagctccaaggttgctgtattcccattcatctccgccgaggggagcatgccaataagaccaataagcttcagcaggtgatgcggtcatgcaatcgtccacatcaggacctgggaaatcattgattcggcacaagaattctggaaactgaacggtggtttccacatcaaatccggcatcaagaagcgtttgatagccatttccgccggcgtcagcacagccgatggtgttgccctcaaccatcactgtcacttggtcgtcttcacaaggcgtggtcaaggcgtgcgcagaaggaacccatggcgatatggcaagaacaatccatagtgcgactgcagctgcaaaagacttcagcgacaggtgaaaagttgaggttcgagacatcactgtacttctctcagatgttaaaactgcaggttagccatcattggtcccatgacaccagcgatggcggcaaggatggccaagatggcgatgataattccagcgccgccaattccaccggtggatccctctgaatcagctgggggagttggaatttctggatctggagttggatctactgggttcgcaatggtgatcagtttatcgttggcgtagttaccgcctgcaaaacctaatgctgcttggccagttgcgcgtcgaatctgatcgctaatcgcagtgttggtttccttagccttcacggtgaaagcaaagccaccctgaatcgatgggtctgcatcttcgccaaattgaacagatgccaggtattcacgagccttgaggtagttttcctcatcgcccgcaagagcaaaagcggatccgacaattcccgtggagttggaattcacaccggtccaagtatttttgacaccaccggtctcatccatcgtggtgacgaggtaatcgagagtggcttgtgtggttggatcctgcgcaccatttgccagagtcaaagcctgtgcagccattgcagtgacatcggaatccgtggttttgcatgtaggttcgattgctgaggctaattggacaccaccgtcggagcacacttgagttttaaggaattctgttgcgcgctcggctgcttcggtttcaccgacgcggtgcagagctagaacgccccaggcctggctgaagttattaattgcagttgtggcttcaccattatctaagtttttgatctgaccgttttcttgaacagcgctgacaagttgcgcgataaaatcagcatctctgacgccgagggcatcttggaaagctacggtcttggctagacgatcgctgaagatgtagtcagaaactgagacatagccctcgagctccggagcaattgcagcatatgcagcgtcgatctctggagaatcaggggcaagcgcatttagggacagcaacagatcctgattgagcccaatatctggagtacctacaggcccagggatgaggccattcgttgcaaattctttttcgatgaattgggtagctaattgaatatccgatgatgcatcctgtgcagcaacgacctgtggagccaacagggaaacaccggttgctaaagccacggttgcagcagaccagcgaatggttctcttcccacgtagatgagccatgaaaacatgtccttaaaatgaattggagaaatgttctgaccccgctttaaggcacacattactgcgcttcaatacgggcttcagaaccgtaatcctcgacggtttggagccactcatttcttattcaggtgatccggcttaatgcaatacctggtgaaagcgattgcataatacggttgcgggtcagcttcgggttctcaccgaaattcccctgaaaaagaacggatggtgtcctacaccataaaatcaccatcggtgctggtcaaatgaaagcccccgtaggggtggcagggaaaatgtaagttcttgcgaagattttttaagaatctgtggctatccaatagcgtcgcattccacggatcgtggattcataaactccaccgcacttttcgatgacgttcctggacgcttcgttatctcctgcgacgcacagcaaaaccttgtcgatgcccaaggcctgagcttcatgaacaccgagtttcagcgctgcggttgcagcaccttttcgacgcgcagacgggcgcacgccgtaaccaatgtggcccgcgacttccaggagatgttggttcagctcgtgccttaaagctaagaatccgacaagaacatcgtcatcatcaacgatccagaaatagctgcagtgcacaaaaccttccggtggtggaaccgaaggatcggccgcgtcagtgcgctccttgaggtagtggtgaaatcctgcttcggaatagtcgatgggaagatagttctcgaaataacccgagccgtggatggggcctgatccgaattcttccaaagcctctttccacatggcgtggcctgacaaatgcggtgagattaatttgtacatcgggccaggttagcagcgctaaccgtgccccgcgtggggcacgcgggggagggctgatggagggcggcgtcgataagcgtgctaggaagtttgtgttttagtgttcacttgctgtactctgtccgtttggactttgcaccagaaaactctatagagcacaacggtgttttaaagatccatgtaaacgtaaacacctactttgttgtaggccccccgccatgaatggcgatccgtgtgggaaatggtagcgagcaaaccgactattgagttcggtgagcgttgagtggccagaaaacacacggttaacgtccaaggtgggaagggaaccccaacgagaaaggcatcaggtcgtctctaatgacaatgactgatccaatcgccgacatgctgtcgcgcgtgcgcaatgctagcaatgcgcaccacgacaccgtgtccatgccatcctccaagatcaaggcaaacatcgccgagatcttgaagcaggaaggctacatcgctaactacaccgttgaggatgcaaaggtcggcaagaccctgtccctcgagctgaagtacagcaacacccgtgagcgctccatcgctggtctgcgccgcgtttccaagcctggtctgcgtgtatacgctaagtccaccaatctgccacaggttctgggcggccttggcgtggctatcatttccacgtcacagggcctcctgaccgaccgtcaggctaccgagaagggcgtaggcggagaagtcctcgcctacgtctggtaatagggaggattgactaaatatgtcacgtatcggaaaagaaccgatcaccatcccatccggtgtcgaaaccaagattgacggacagctcgttgaggttaagggtcctaagggcaccctgaacgttaacgttccagagccaatctccgttgcagtggaagacggcaagattgtcgtcacccgcccggatgatcaccgcactaaccgttccctccacggtctctcccgctccctggttaacaacctggttgtcggcgtcaccgagggctacaccatcaagatggaaatcttcggtgtcggttaccgtgtcgcgctgaagggcaaggaccttgagttctccctcggctactcacacccagttctgattgaagcttctgaaggcatcactttcgcagttgatggcaacaccaagctttcagtttctggcatcgacaagcagaaggttggacaggtcgcagcagtgatccgccgcctgcgtaaggacgatccttacaagggtaagggcatccgctacgagggtgagcagatccgccgcaaggtcggaaagacgggtaagtaagcaatgagcaacactgaaaacaagcagaagcgcgtttccgttggcaaggacatcgcgactcgtcgtcgcgttgcccgtgcacgccgccacttccgcatccgcaagaacctgcgtggcaccccagaggctccacgtttggttgtccaccgctcttctcgccacatgcacgttcagatcatcgatgacgttgcaggccacaccctggctgcagcttcttccatcgaggctgaggttcgcgcaactgagggcgacaagaaggctaagggcgcaaaggtcggtcagctgatcgccgagcgcgctaaggctgctggtatcgagcaggtcgtcttcgaccgcgctggttacaagtaccacggccgcgttgcagctctcgctgacgccgctcgtgaaggtggtctgaaattctaatgatgaccatttctaagaacatcaacggaaggattgcgtaatgccgggacgtgaacggcgtgacggcggacgctccgccgacgacaacaagcaaaacgatcgcaacgagcgtcgtggcggaggccgccgcgatgaccgtcgcaatcagcagcaggacgagcgctcacagtacatcgagcgtgtagtcaccatcaaccgtgtgtccaaggtcgtcaagggtggtcgtcgcttcagcttcaccgcacttgtcatcgttggcgacggcaagggaatggtcggtgtcggttacggcaaggccaaggaagttcctgccgcaatccagaagggtgcagaagaggctcgtaagaacttcttccgcgtcccaatggtcaacggcaccatcacccacccagttcagggcgaaaaggcagccggcatcgttatgctgaagccagctgctccaggtaccggtgttatcgccggtggcgcagcacgtccagttcttgagtgcgcaggtatccaagacatcctgtccaagtcccttggttctgacaacgctatcaacgtcgtccacgcaactgtggatggcctgaagcagctggtccgccctgaagaggttgcagcccgccgtggcaagaccatcgaagaggtcgcaccagcacgtattctgcgtgcacgcgcaggtcaggaggcgtaagaaatggcgctgaagattactcagatcaaaggcactgtgggcaccaagcccaagcatcgcgaaaatcttcgttccctcggtctgaagcgaatccgccacaccgtgatccgccccgataccccagaggtacgtggcatgatcctggcagttcgccacctgatcgtcgtcgaagaagtggcgggggagtaggtaacaatgagcgaaccaattaagctccacgatttgcgcccagcagcgggctcaaacaaagctaagacccgcgttggtcgaggcgaagcatccaagggtaagactgcaggtcgcggtaccaagggtaccaaggcacgcaagcaggtttctgcagcattcgaaggtggccagatgccactgcagatgcgtcttcctaagctgaagggcttcaagaaccctaacaaggttgactaccaggtagttaacattgcagatctcgcagagaagttcccacagggcggcgacgtcagcattgctgacatcgttgcagcaggacttgtccgcaagaacgaactggttaaggttcttggcaacggcgacatcagcgtcaagctgaacgtcaccgctaacaagttctccggctctgccaaggaaaagatcgaagccgctggcggctccgcaaccgtggcataagttcaccagaactttaaaaatgacctccaagggaaaccttgggggtcatttttaggttttttgggaggacctggggttctcggagggggattgcgcagggggcctactgattgggtttgatttgagtgcatggaaaatgccactctgtggggtaacaagagtggcattgcaaagagacttacttagtgggtggggaagccaagctcaatctgtgattcatttggaagaggccagcgagtggtaaccaccttgcttcgggtatagaagttgaaagactcagatccatacatgtgtgtgtctccgaatagtgagtctttccaacctccaaatgagaaagcgccaattgggactgggattggcacgttaatgccaaccattccgacttcgatgtccatctgaaattctcgagctgtacggccatcaacaactattgaagcgccttctttcaaggctgaatcgagaattctgtccgcacgtccctgtgcctgagaattggaactttccaacctggccttttgaaggggctctattggcgaatatcttgttcttggcttgtagagattccggtgaggtttgattttggcgaaaagggttaactagtagcttgacggcgcctgggccacattcggctaataagtagggaagattcggcgatgactgctcctgaagccacaaggaggacggcgacatcgagaattccctcgggaacggtgatccagagatagatgcaaattcccacaatgatcaggccaacaagtcctacggtcagaagaacccattggggagatttttgagtgagtgctgcggtaatgatggccgaagcgaaggaaagtgcaaggataaagccaattaccactatgtctggaatagaaccaatcttgaaccacaaacaaagcgcgacaagaactactgcgtaaaaagcaagaatcgatttaccgggtaccgggggatgttgcactgcgcggactcctgttgggcatcaaatgttctaaatgggaatagcttttaataagcaaaccatactgagcatggatgatcattagtttgatgcgatacaaatgggcttccctaaaactaaacacccgccacaatgaaacgcggcgggtgtttagctgagaactttcagtaactaaatggttcggtgaatactcttgtatgtcaggtaagcactgaggccttcgatgccgtattccactcccataccggattcgtggcgtcctccaaatggggcggaatggttggaaccgaagaagttgatgcctacggaaccagaatccacttgacgggcgacttctagtgcttgttcctcatccgcaccaaataccaagccaccgagaccgaatttcgtgttgttggctagtgcgattgcttcggaaacaccgtttgtatcgtcgtactttaggatggaaataacagggccgaagatttcttcgcgtgatatccgcatgtcgggggtgacatcggcaaacacggttggttggataaactcgcctgattctaaaccttcagaaaggctgattgaccgggttccacctgcaaccactcgtgcaccttcctctcgtgcggagtcaatgtaagacatgacggttgagtactgagaggcgctggcaactggcccaaaaaccgtttcttcatcataggggtcaccttgtctacctgcagcgatagtgcttgccactgtttgtacgacttccgcatagcgtgagctaggggcaataatccgggtactgatgtagcaggtttgtccagtgttgcgcatacaggatcgaatcaaccgcgtcgagagtactgacatgtctgcatcaggaaggataatcgcggaagattttccgcctagctctaaagtcactggtcggagtagttctccgcaggcggcagcgatcttctttccaacaggcgttgatccggtaaacgctaccttgtctactccggggtggcggacaagggcatcaccgaaacgccctgaaccggtgagtaggttgactacgcctgctggcactccggcggcttcgatggcttcgatgatgaaacggatcgacagtggggtgggggaggctggtttgatgatgacggtacagccggcaagaagtgctggtgccagtttgatgactacaaggttgatcgggaaattccatggggcgatgagtgcgcagacaccgatgggatctttatccacgatggattcggcgctaccggcaggaaatgggcggatgtcttcgccgtctaaccaaggcgcgagagtggcaaagtaacggaaaattcctgctgcattggacgcagctccacgggtctcggaaatgggggaaccattttcgcgggtattagtaagtgctagagcttcagaacgggattcaatttccgtcgcgattttcaggaggtagcctgttcgttccgcacctgtaagtgcactccacgactttagcgctgtacgtgcagctcccaccgcagagtccaattcagatgcggttgcttctggaacagatccccattcttgaccgaccgcaggatcaactacggggttgcgttgtgttccttctgctttaacccaggaaccgttgatgtagaaatcatcgacatgggtataggggagttgcagagaagcacgcctggttgcagcattcatcggatcgcatccgttcttaacagggcctttgcacgattgaggtctgcagtagccatctggtgtgcagcttcggtgattaattctgggaggatttccctgtgcaggcggtcgacataatctgagactggcatcccgaaccatgagctagaagccgtgatcccggcgcggtcgaaacgccagagtcggtcgcaatcgcgaacaagagcgtcttctagtgagtaggccacttggcgggtgtcgtgtccgtcgatgatgtcgcagacatgctcgacaaaatcgacagtatatccgagggatggaagcactcggcgggccacagtgcagccttctgtttcgtgttcgaagcggattgctgctttgcgccagtttccggagaatccttcggagatgattcggctctcatcgacatgtgcccagcccgtgtcgtggaggattgcggctacgagaaccaattctctatctgccagtgggtaagcgtcgcagagacgttcagcgtacgccacgacgatgggaagatgaatgtcgttggcgcgggtgcgggtttccggctcaatggctttccataattgctcaaatccatttgaaggtgttgcacagatagcggtggtatcaattggacctacggccgggatgggacgaatcccaaaatcctccgcaaaagtgatggcgcggggatcagaggcgtggacgctggggtctgcttgctcccaagcgggtaaattactgcgagtcatcgggtaacctccaggtcaacggctagttttttcagcggctgcgaaatatctgcagcaaggtcggcggggatattttggttcctggaaagtgcactgcgcacagccatgaaatccagtggagcgttgacgcaatcggcggcgatgatgttgtcgccacggtaataaaggacagagaacttctttttctcgggatcctgtcggattactgtgctgtcataaccaagggtaagtcctgcaatttgtagtttgagatcgccttggttggaccagaaccaggggattccggcgtaggcttcgggctggccgacgagtgagtatgcagcgatctttgcgtgctcgatggcgttattgacgctttctagtcggatgcgttcatcagcgggggaaccagggattggattgggaatgttggcgacatcgccaatcgcaatggtggtgccatctgacgcgacggcatgtttatccaccacgatgccgttgttgatgtctaagcccagaacagcggcaagttctgtgttcggaatgacaccgatgcccacaatgactagttgggcaggaattactgtgccatcttctagctcaatgccgctgagctttccatccttgcccacaaactgtttcatgcgggcatcaagcacgatatttacgccacgggaacggtgttgttcgaggaagaatgctgcggtttcttcacccaccgctcggccaatcagacgcggaccatattccaggacggtgacatttttgccgaggtcatgaagcgaacacgcagcttccaatccgatgaacccaccaccgactacaacggcatcggtgacagaaccaatcatcgctttgagcgccaaggcgtcgtccgcgttgcgcaggtaggtgacaccctccaaggtggcgcccgggaggtcgaggtggcgagggcgggcaccaaccgctagagcgagacgtcgaaaagcgaattcttgtccggcgccgtaggcgacccctgatccgtcgtcgttcttttcaatgcgttcgatgcgcacgcccttgaccaggcgaatattattttcttcccaatactcattggaacggaaaatcagacgctctttgtcgatcttgtcctggaggaactccttggacaaggcgggacgctggtaggggcggtgatcctcctcgcctagaagcgtgatcgattcggtgaaacccgtggcccgcagggaaatcgccagctgcacacccgattggtttgcaccgatgatcaagattccagtttcagctgaagtattcatgattcaacctcacacttgcgtttctggcgtggtcaacgaaagatccatgccttcggtgaccttgatttggcaagacaaacgggagcaatcctcacggtccacggcagcaccccacagcatttcatcttccatctcctccattgggggaagcgcatcatactgtgcagggtcaacaaacacatggcaggttgcacacgataaggaaccgccgcattcagcaacaattccaggcactccgtttcggactgcggtctccattactgaatcaccaacagtcgcctcgatggtgcgggttttgccagcatgatcaatgaaatgaatagtagacatgatcttctccttagaacttttagtacttagatgaactgtcggccaccatcaacgatgagtgtttgcccagtgatgtattcggcttctggggatgcaagaaacatggtggtgccgacgatgtctttcggttggcttgcgcgcttgatggatccgcgatcgacaccgtacgtttccgcgctatccatgagtcccaagctggcttcagtcagcgtaaacccaggcgcaaccgcattgaccgtgatcccacgaccacccagctctttagcaagcaccctggttaaagcaatgaccccacctttggatgccacgtagtgcgcccagtgtgcagatcctgaaaacacagtcgcgctggaaagattgaccacacgggcattatcggacaaaaacggactcacagaacgcgtcaccaaccacgggcctttgagattgactcccatgaccaaatcccactccgcagggtcaatatcctcaaacggtgaacgagtcactgtcgcatatatcgctgcgttattaataaggacatcaattcggccaccgccaaactcagcggcaccggcggctagggcctcggtggactccaaagacgtgacatcaacttcaaaggctgcggcatctgcgcccaatgctttcagcttgtcaacggtctcttgcgccccatccagattgatatccgccaccgcgatacggtctccttgggctgcgaaaccttcagcgaatgcccgacccaaaccgccagcggcaccagtgataagaacagtgcgtggactaggcatgtgtatccaccccatgtgctgctactgagtgcgcatggctgtgcgcgccgggtccttcgatgcgtggcgcatctggatcaacaatgacaaccttgcccttggttccatcgaccttgaggtaatcgccggttttgatggtggtggatgcagcgccagttccagtaacagccggcaagccgtattcgcggcacacgatcgcagcatggctcatcatgccaccaatatcagtgactgttgccttgattttgccaaagattgggccccaagaaggtgctgttacaggggcaacgaggatttcatcctgctggatttctgaaaggtcatctgcgctgagaattactcgagcgtagccttccaccacaccaggggatgcagccatgcctttaagggttccttcttcggcatcctcgtcattgcccaaccatgattgcacctgttcggtggtgattccccagagcatgcgggtgaaaggttcggtgatggactctggaggagtgttaagagctggcgctggtcgggcagttttcaaagcggtgacaattgcttttcttcgctcaatttcttccggccaaatgatcgtgccaattggaccaccgggtgcgccgacaccccacgcagtagccaggtcgaagaggacatcgcggacttcagtgcggttgaggtacaacatgtcatcctcgttctcccagaaaccgtagccctggagagtgcgggaaagttcgcgtactttgcgccaaaatactgacatggtccagtgctcgatgtagaagttatggttttccacataggggtatgcagtagcagcgaggccgcatttagcatcaaactgcgcgagttgttctccatccaaaaggtcgcggtattcttccaccacgcgttccttttctgcgatgagttcatctttcgggcgggagatggtttggccttcatctaggcggcggatgtaatccgcgatgtaccccagtggaagttccaggtgctcgatccagtatttatcgtgaccgtagaagccattaccgacggtgaagttgaaccacggatcttgtgcttcttcccagcgcgctatccatgtcgcgccgccttctgcctttgcgatagcagccaaggtagcttgcggatcatccgggttggcaaagtgagtttgcaggccaaggtcgaccgctagctgtgccagaatctttagttcatcatcggggcggaacagctccatatccacgccctgaaccatcatcgaaattgattgatcagggatatctgggaagacttccttgcagaaattgaagaaatctaggtaagcgatgtaacccaagttgaggaactcaaagtggtattgccagttttggtaggcgagctgaatgagccgatcgaagttttccatgagtacttcggtgccgtctttggcttttccggagacaatatcatcgataggcacgtagtcaggcagtggcttgaattctagagattccagctcattgatggttcctaatactcgctccttccaatttgccagcattggctcccagttttggaagtagtgcgtgatgcgttcctggaacatggggacgcgttccgcaatctgatcttcaggcactggaataggggacatatagaggtatcccagatgcacgcggaactcgatgccattggcattcgggatcatcaaatgccgagcgttgtattggccgaggcactttacagcgaattcaccaccgatagtttcaaaaggcttgaacacagttggccagtgctgtgaatcgcagaaccagaatttctcattctcttgatccatgagcttgtcttggaaaacgaggtagtacgggtacagatcttcccaaccttcagcgcccttgggcactggaagatcggagggcttggggaaagatttattagccatggtcaaactccttttagatgcttttcgacgaaaagatgcggtggttttacttcgtgccggtcattgcgacggtgattgagctgaaatcgaaggtgcctatggttttggcagcctgcggagttggggtttccttcttcacaccgttggagtggatagtttccgggcgggattgcaataacagaaggttttctccatctggcagatcagcgtccagcgcccattcgatatcttgtgggcacttgtagtgtttttctgcacgcttagccatttgtgccacagcgagcatttcctcatcagtcagactgcggcggtttgcgcgttcttcatcaacgggcttttccacgaggcttccactggtggcatcggggatgagttcagcgtgtttgcttccaatgtgttcggagacaacctgcagcgtgatcttgtccagcaagatattgtctggtgtcacttcacctgagaccaccatttcaccaacaccccatgaggaatcgatggtgatcttcgagcggtcgccgttggaaggattcatagtgattgccacgcctgcgacacgagagttgaccattttttgaacaactaccgccatggagaggccctcattggggatgttgtttttcagacggtagataatggcacgggaagtgaacagcgaagcccagcatttacggatgtgttcagtgacagcgctcaaaccgacttgccacagataggtgtcctgttgccctgcgaaggaagcatcgggcagatcttcggcagtggccgatgaccggacagcaaccgggacgtcgccaccgcatcgttccatgagatcgcgataagcctggtgcactgcgaaacgagcattctctggaacgtcaagactgcacagctcatcgcggatgatcgcagaaactcgatccacttccttaacatcttctgcatcgagatcgtttaggaatttatcgatgtgttcagcaacccctgcttcacggatgaattcatcaaagctggcagtagtgaccacaaatccaggtggaacgggcattccagcatctgtcatggtgactagtgaagcgcccttgccaccgagtacttctagaacaggatccaggccttcatcgaagcgctggacaaacgggatgttcaaactgttggtcatggtgtctccttatttaataaagcgttaagcgttccaagtcacgggaacagaagtggggacgcggaaggagaggttctcccggaacccgatagctttgtccgcaaccaagtgcagggaaggaacaagcctggtgacttcctcgagacagatcttggcttgaagtttggccagcatgtttcctaggcaatagtggatgccgaaaccaaaagacaggtgctcgcgcgcattagcgcggctgatatcgaattcctcgccattttcaaagcgagcttcatcgcggttcgcggaacccatgagcagcagaacaccatcgccttccttaatggcaacgccgccgatctcggtgtcttttaatgcttttcgacgccaccccacgatcgagccggagtaccgcaagacctcatccactgccgcaggaatcagttttggattctctagaatggcttgccactgctctggatgatcgaggagaactcggaaacaattggagatcaacgtggtggttgtttcgtgccccgcaaaaagcagggagtacagcaaagaagcaatctcatgatcggtgatttcttgaccctcttgctgtgctcgcactagatcagcggtgaggttgtcgccaccgtgtgcatgtgcatcagctaccatgcgttggcattcctgccagtactcaaccaaattgtgtgcgtgtgggatctgctcttcatcactaagatcgccccaggtcatggccgcacgggaatctgaccaccgcttgtaggtgtccaccatggaaatatctgcaccgatcagcgtcaggatcgtgatggttggaatgtcgtaggcaagatctgacaccatatcgccgacgtgttgatcattcgccaacattttctccacacgatcaatcaccattgctcggatatctggttcgagtgctttatagcggcgtggcgtgaaggccttttgtgcgattgcgcggatgcgggtgtgctctggtggaatacgagctgataatccggagtatgcagtgaagccgccatcggtcatgatttgggttgcctgaggtccacgcttgcggactggggcttgtgcattttcagaggagaatgtttcccagtcatcaaaggtggttttgatgtcgtcatatttggttaccacccagtagccgatgcgctcatcgaacatcactggctcttcctgacggagttctttatatgcaggaaacgggttgtgcatatcgaaaggctggtagccgtgatggctggtggactctgatgtgtgcccgaatgggcatccaccggttgaggtggattgttgggaagtctgggaagtcattgtcatctcctgacacttgtgtgtggccgaagccgatcacagtgaagtttgaatcacttttcctaaagattcgtgatggctatcacttttaggtgtgactcaaagtgtcgtcaagaagagatgaagatacgaattcagattccactcagtggaatcagttttagtttatgcagatggagggcgggtttaggtatcgccttttcgttctgcatttttgtgtgaagccaaaagtgtgtccaaaggaatgagcgcggttgcttttgtaattctctgacttgtcgcctgaaggatcgggagatagcgctcaagatttgcagcctgtgcggtgggaaccaccaaccccagtgctgctcccagttttcctgtatgccagaccggtacggcgatcgatgcgccgccgattcgttgctcgtcatgtgtgatggcaaagccttgcgagtgaatttgtttcagctgcgcagccaagacgtcgggattcacaattgtctttggggtggaggcgttgagtggcagcttgagataggactgttttacccatggctcatcaaacgcaaggagaatcttgccaaccgcagtggagttcagaggtagtcgaccaccgactcgagccgagcgtggaattttcttcgtgccgtaggctcggtcaatcaaaagtgcttcatctttatcgcggaccactagctgcgcagtctcggaagtaagtgagtagagctcttggatgaacgggcgtgcagtgtcgcgtaactgccgtcctgtattttgggcgagttcccagatacgtaagcccaattggtagcgcccatcagatttcttgctgagtagtccgccttcggttaattcagaaacgagacggtgggtggtacttggtgggaggtctgccagctcagcgatttcagtgacaccaagtggacgcatggtgtgttcaaaagctcccagtacggcgatcaccttggaggtgactgtacgtccaggttcgcgatttcctcccgccattatttaatgctcctctaagttcccctggcactccgatgaagggtaaaagttttgaaaggtatcaaatcggccagtgtaacgacgtattgttcaagcctatcgccaaatctttgatgcgacacagacccagtatttttattatccaacacttaaggtaactattgggcggggtaggggaggagcttttcgcacctatgatgcgtcttacaaaaaaaggggttgccatgcggttcttgggtaaatactggtagggtggacaagtcaatcgtgtccgatttgtaatcggaccaggatctaaagaacacatctcccggtaccttttagtcactattgtgaaaatatgtgggtttaagtgctgaggaggccaggaggataagtgtccgccattattcaggcattcaaggacgccgatctgcgtaagaagattttcttcactatcgcaatgatcgttctataccgcatcggtgcgcagatcccttccccgggagttgactacgcaacgattagtggtcgtctgcgtgacttgactcaggatcagtcaagcgtttattcgctgattaacctgttttccggtggagcgctgttgcagctgtccatttttgctattggtatcatgccgtacatcacggcgtctattatcgtgcagctgctgactgtggttattccacactttgaggagttgaagaaggaaggccagtctggccaggccaagatgatgcagtacaccaggtacttaacggttgctttggcgttgctgcagtcttcaggcattgtcgcgttggcggaccgtgagcagctgcttggcgcaggtattcgtgtgctgtcggctgatcgcaacttcttcgatctcattgttttggtcatcaccatgactgcaggtgcggtgcttgtgatgtggatgggtgagctcatcacggaaaagggcgtgggcaatggtatgtcgttgctgattttcgctggtatcgcaactcgcctcccaactgatggcatgaacattctgggtaactccggcggcgtggttttcgctgttgttctggcttccgttctgatcctggtcattggtgttgtattcgttgagcagggccagcgtcgtattccagtgcagtacgcaaagcgcatggtgggacgtcgccagtacggtggttcttccacttacctgccattgaaggtcaaccaagctggtgttatcccagtgatcttcgcgtcttcgctgatttacatgccagtgctgattactcagatcgtgaactctggttcgctggaagtgtctgataactggtggcagcgcaacatcattgcgcacctgcagacgccttcttcctggcagtacattgttttgtactttgcactgaccatcttcttctcttacttctatgtttccgttcagtatgatccagctgagcaggctgaaaacatgaagaagtacggtggatttatccctggtattcgtccgggccgcccgactgctgagtacttgggattcgtcatgaaccgcctgctgtttgttggttccctgtacctggctgtcattgctgtgctgccaaacattatgctggatctaggtgttgacgccggttcggccggagcaactccattcggcggaaccgcaatcttgattcttgtatctgttgcactgaccacagtgaagcagattgagagccagctcctgcaaagcaactacgaaggacttctaaaataatgcgactcgtactcctcggacctcccggtgctggtaagggcacccaggctgcaattctctctgagaagcttggcattcctcacatttctactggcgatcttttccgcgccaacattggcgaaggtacccctctgggtatcgaggccaagcagtacatcgacgctggcaagctggttccaaccgacgtgactgcacgtatggttgcttcccgccttgctgagtccgatgctgcagaaggcttccttttggatggtttcccacgcaccgttgagcaggctgacatcttggctaacctgctttccgaagctggccagaccctcgatggtgttgttaactaccaggtttctgaagacgtcgtcgtggagcgcatgctgtcccgtggtcgcgctgatgacaacgaagagaccatccgcacccgtctcggtgtctaccgcgacgagactgctcctctgatcgatcactacggtgacaagatcatcaacattgaggctgaaggcgaagtcgaagagatcaacgctcgtaccctcaaggcactgggcaaataagatttcttctctagtgctgctgaatctacgatgataggtagatagcaagcagtgacgtggaagtactcacctcaaggtggccggaaccgcatgcattgtgcggtgccggccacctttggttttaacagtttaatttgaagaaagagacgtggaagcatgggtttccgttccaagaagaaggttattgcggcaaagaccgccgctgagctggacgcgatgcaggcggcgggtgagatcgtcggcaaggctttgcaggctgtgcgcgctgaggctaaagctggcatgagcacgtgggatctggatcagatcgcggagcaggttatccgcgatgctggcgccgttcctacattcctgggttaccagggttttccggcatcagtgtgcgcttcggtcaatgaggtgattgttcacggcattccatccaaggagaccatcttggaggaaggcgatctggtgtccatcgactgcggcgcaacctttgatggttgggtcggcgattccgcgtggagcttcggcatcggcgagctggacgaggacgtccagggtctcaacttggctaccgagtgggtcctcatggaaggcatgaaggccatggttccaggcaaccgtttgaccgatgtctcccacgctctcgaggtcgcaacccgcaaggctgagtccaagttcggcgtcgcgctcggcatcgtcgatggctacggcggacacggcattggccgccacatgcacgaggagccatacttggctaatgagggcaaggccggcaagggccctgtgattcaggagggctccgtgctcgccattgagcctatgctcaccctcggcaccgaagattccgcagtgctggaagatgattggactgtcgtgactctcgacggttcatgggcatcacactgggagcacaccgttgcagccaccaagggcggcccgcgcatcctcacgccgcgttattaaaatgatgcttttcgacgcatccccacgttttggggctaaaagttgcccggttgagcaaaggtttgcgacctccccggcgtgccgccaggggaggaggcgataaaacttttttacctttcgaatatcaaaatcataaaacagccttatatacttcaacgtatggcgaagaattctcgaatccgatacagcgcgtcaatcaagcgtgccgcagctgcaatcctcaccgcagctgctacctcagtcgcgttgatcgctgtgccagcaactgcttcagcacaggacctcgcaaccggcagctcccagatccagactgatgctcgtgaaggtgcgtgggcaacccgcaacaccatccaagaccaacttgcctccattgggccagcagccctcccagtccgcgcagcggtagacaatgccatcaacggcatgttcccaggacttgttgatgaaaaggttgcagcagagcaggaagctgcacgcgcagaagctgagcgcgaagcagcagctgcacgtgaagcagaagcagcccgcgtagccgcagaagaagccgcacgctttgaccgcggctcttgcccagcaatcgctgatgtctgcgtggacattgatggtggacgtacctggctgcaggaaaacggtcaggtcacctacggtgcagtcccagtttcctccggcggagttggccaggaaacccctcgcggaacgttctacatcaaccgcaaggtcaaggatgaaatctcttacgagttcggtaacgccccaatgccgtacgccatgtacttcacctacaacggccacgcattccaccagggcaatgttgcgactacttccgctggttgtgttcgcctaaacactcaagatgccatctactacttcaacaacgttggcatcggcgacatggtgtacatctactaaaactcaccgttgctagcaggcgcgttttcagatcatgattgattgggcgtgcctgcttttgtgttttttagggaccccaatgcgcgtgattcaactcatgtttgatatgtgctcctaaggtgtgtaacctatatcgatggtgtgcgtacatcttgagtgacgcaaccattttgaagtggaaaaacttaaggcctcccgcaggggagtgttctggaaaagcggaggatatggctaaggaaggcgctattgaagttgagggtcgcattgtcgaacctctgccgaatgcaatgttccgagtcgagctcgacaacggacacaaggtactcgcccacatcagtggaaagatgcgccagcactacatccgtatccttcctgaggaccgcgtcgttgtagagctgtcgccctatgatctgactcgtggacgaatcgtttaccgctacaagtaaaaataagctttaagcctccatatatcagggccagtcggggatatcccggcaggctgacacaccttcaggcaacgatggctgaagccttgcgaatcacaatccacctcccggtttccgtccggggaaagtattgcttggcaggggcgattatggggaaaaccatcgcaacaaccggaaaggtaactgccacatggcacgtctagctggtgttgacctcccacgcaacaagcgtatggaagtcgctctcacctacatctacggaatcggcccagcccgttccaagcagcttctcgaggagaccggaatctccccagacctgcgcaccgacaacctcactgatgagcagatcgctgctcttcgtgacgttattgaaggcacctggaaggtcgagggtgacctccgccgccaggtacaagctgacatccgtcgcaagatcgaaatcggctgctaccagggtattcgccaccgccgtggcctgcctgttcgtggtcagcgcaccaagaccaatgcgcgtactcgtaagggtcctaagaagacgatcgccggaaagaagaagtaaaaatgcctcctaaagcacgcactaacgcgcgccgcacaggccgtcgcgttgtaaaaaagaacgttgctaacggcaacgcttacatcaagtccacctttaacaacaccatcgtttcgatcactgataccaacggtgctgtaatctcttgggcttcctctgggcacgtcggattcaagggctcacgtaagtccactccgttcgctgctcagatggctgcagagaacgctgcccgcaaggcaatggatcacggcatgaagaaggttgacgttttcgtcaagggcccaggatcaggccgcgagactgcaatccgttcccttcaggctgcaggcctggagatcggttcaatctccgacgtgaccccacagccacacaacggctgccgtccaccaaagcgtcgtcgcgtttaatagggaaggaaaggtaatacaaaatggctcgttataccggcccagcaacccgtaaatcccgtcgtctgcgcgtcgaccttgttggtggagacatggcgtttgagcgccgtccttaccctccaggacaggcaggccgtgcacgcatcaaggagtccgagtacctgctgcagctccaggagaagcagaaggctcgtttcatctacggcgtcatggaaaagcagttccgtcgttactacgccgaggctaaccgtcgcgcaggcaagaccggtgagaacctggtcgtcctgctcgagtcccgcctcgacaacgtcgtgtaccgcgcaggtctggcaaacacccgtcgccaggctcgtcagcttgtttcccacggtcacttcaccgtgaacggcaaggcaatcgacgttccatctttccgcgtttctcagtacgacatcatcaatgttcgtgagaagtcccagaagatgaactggttcgaagaggctcaggacaacctggccgacgcagtcgtcccagcttggctccaggtcgttcctgagaaccttcgtatcctcgtgcaccagctcccagagcgcgcacagatcgatatcccactgcaagagcagctcatcgtcgagttctactcgaagtagtttttgcttacccggctgccccgggtgcacaggaatctttcgattttccaaacatccttcatggttttagaaacctttaccgacgtcaaatagcggtcgtcactcaaggagagttcaatgctcatttcacagcgcccaaccatcaccgaggaatttgttaataacgcacgttcccggtttgtcatcgagccactggagccaggttttggctacaccctcggtaactccctgcgccgtaccctgctgtcctccattcctggagcagcagtaaccagcgtcaagattgacggtgtactccacgagttcaccaccatcagcggtgttaaggaagatgtctctgacatcatcttgaacatcaagggattggttttgtcttctgattccgatgagccagttgttatgcagctggtcaaggaaggcccaggagttgtaactgcaggtgacattcagccaccagcaggcgtggagatccacaacccggatctgcacattgcaaccctgaacgagaccgccaagattgagatcgagctcatcgtcgagcgtggacgtggctacgttcccgcaactgttactgcaaccggtggagagatcggccgcattccggtcgatcagatctactccccagtactgaaggtcagctacaaggttgaagctactcgtgttgagcagcgcaccgactttgacaagctggtcatcgacgttgagaccaagaactctattaccgcacgtgacgccctggcgtcggcaggtaagaccctggttgagctgttcggcctcgcacgcgagctgaacatcgcagccgagggcatcgagatcggaccatctcctcaggagaccgagtacatcgctgcctacagcatgccaatcgaggatctggacttctctgtccgttcctacaactgcctcaagcgcgaagacatccacaccgtgggtgaactcgcagagcgcgctgagtccgatttgctggatatccgcaacttcggacagaagtcgatcaacgaggtaaagatcaagcttgctggcctgggtctgaccctgaaggatgctcctgaagacttcgatccttcaactcttgaaggttatgacgccgaaactggtggctacatcgatgtcgaggcggaagattccgagtaagtcgcatggtccaattcatgggccgcgctaaatcaacgtacaaggagtacatctaatgcctacccctaagaagggcgcccgcctcggcggatccgcaagccaccagaagaagatcctctctaacctggctgcatctctgttcgagcatggcgcaatcaagaccaccgatgctaaggcaaaggctctgcgtccatacgctgagaagctgatcaccaaggctaagtccggttccgttgcagatcgtcgtaacgttctcgcactggttcctaacaaggaaatcgtggcttacctgttcaacgaacttgctcctaagttcgagaaccgtccaggtggttacacccgcatcatcaagctggagaaccgtaagggcgacaacgctcctatgtcccagatctccctcgttctcgaggagaccgtctccgcagaagcatcccgcgcaacccgcgcatctgcttccaagaaggctgctgaagaggctgagaccgaagaggtagtcgaggctccagctgaggagaccgcaaccgaagaggctgcagaagagaagtaaatttctctaactccgcatagaatgcccgcagtgaacattgtttactgcgggcattttacgtatctgcaccccgcccggctgcgctgagcagccgtaaagcgtggggcgtgacgtcgaaaagcaaaaaatgaaaggcagacatggacaattcaacggtgcgaatccggctggatctagcgtatgacggcacggattttcatggctgggcgaagcaggggaccagcgatctacgcaccgtgcaaaaagtgttggaagacaatttgagcatggtgctgcgtgagactgttgaattgactgtggccgggcgaaccgatgcgggggtgcatgcggcgggccaggtggcgcactttgatattccggcacacgctttagagcagcgcagtattgatggcgatccaagcaagttggttcggcgcttgggtcggttgctgcccgatgatattcgggtgcatggcgtacgttttgccgagcccgggtttgatgcgcgattttccgcgatgcgcaggcactacgtttatcgcattacgacgcatcccgccggcgcgctgcctacgcgccgccacgacacggcgcagtggccaaaacctgtcgaactagagcggatgcaattagccgccgatgcactgctggggctgcatgattttgtggcgttttgcaaagctaagccacatgcgacgacggtgcgtgaactacaaaaatttgcgtggaaagacgtctccactgacatcgaaccgcaggtgtatgaagcacacgtggtggccgatgctttttgctggtcgatggtgcgctcgctggtcggctcctgcatggccgtgggcgaaggacgccgcggatcagggtttactgcagaattgcttgatgcaagcgaacgcagccccatggttccagtagcacctgcgaaaggtttgagcttggttggcgtggattatccttccgctgataagttacaggaaagagcgctggaaacccgagctgttcgcgagtttccggacgcgtccgcgagcctaaaactagatgatgagtaaaagggactaaactcgtctctcgtatctttcagtcatttatgtctgataagcaggcgcgtgcgccacacaattggcacaatcacaagaaagtgaagtgggaacctagatgctgacgacactatggattgcggtgttggtatttaccgttccaggattggtcgtctcgtgggtttctggccttaaagtgccctgggctatcgcagcctccatcccagccaccttcggtatttacggcctgtccgcctggttgctgggcttgtgggagatgcgttttgatctccattctgtagttatttccacattggttttcgctgcggttgctttggtatggcgcttgttttttgtcggtggttggcttgtacgtcggcgtaaagcacgtatccgcaggcagacgctcgcggatgaagagcgggcagaaaatgctgaggtatctgcaggggagcctgccgaatcgagcacaaacgaagcagccgaatctgaatctgaaacctcggagcgtcgcggaatctggcgcgtgatctttgattacatgcgcgacggtggcatcttggatcaccgttggctgctgcctgccgcaggtgctatcactggtgcgtggctgatcattgatcgtgccgttgatctgctcttgagcaccgagcatggtttgggcgatatcgtccaaggctgggatgtccattggcatgcttcgactgtccgttttatagatgagaccggcattgcgtcatccacgatgatggggcagctgcgcaatattgaaacgcagcaagatctgttctacccaagcgcatggcatgctggtgcatgggtgctgtcggatgtcggaaatctgacgattgttgaagccaccaacctcactggcattgtgctgtccggattgttgctgccgttagctgttgcactgattgcatggcggatgatcaacaatcgtggactgaccgcgcagattggtgcgggctttgctggactgatcaccattgcctctccggtactgttctgggttggtaactacgtgggtgcgtggccttatgttgctgcgatcggtgcttcaggtgtggtgcttgcgctgtttatgtccactccgtctgtgccggtaagaatctttgccgcagcattggcgttcatgggtatgttccagctgcatccagccccatccaccatcgtgatcatggtgttgctgctgtggtggctgctcaaactcgtggtggttccaagccagaaagtgaagggctggaaggcgggcatcggtatccgtttgaaggatgtcggcatcctggccatcacgggcatcatcggtgtgctcttcatgctgcctcaggtgatttcaggttccgaacaaaccgaagatgtgctgtcatattctgctgaggaacaagtcacccgcagcgagtcctggttggtgtctattttcatggagacccgccatgttgatttcttcggaaatattgacatcgtcccagtgctggtattcgcagcaatcggtggcgtggttgctttggtgtggcgcggaaacttgtgggcgccggtgttttacttcgccagcgttgcgttgaccgctaactcgctgaagccttttgaagagccgtggggtgattggctcaacatcgtgggcggtctgcattactccacaggacaccgtttgatcatgcctgtcgccatgttcacttttgctgccgcaggtatcggcgctgccgcagtgatccgtttgatctgcttgggaccaataaagaagttcaccactgtttccggtgttgtttctgtggtgatggctcttgttgtggctgtgccattgcagacttgggcgaaggattttgtagaggaaggatccgaaaccacaatccttgcgccacacaatgatgaacgtatggtgagcaacaacgacttggctgcctgggactggttaatccaacagccaggtggagctgacatgaacatcatgggtgaccccgcagatggtaacggctggatgtatgcctacaacggcttgcactccgtggcccgccactatgcatggccagcagcaggcgaaggctctgccaccgcgatgctgttctggtggcctcaacttctaggtgtgggcaccgatgaaaacccagatcaagtcaacgatgtggatcaggctgctcgtgatctcaacgtcggctacttcatgatcagtccgtggacgttctgggatttccagatccccaacttccgccagatcgatctgctgtggcaaaccccaggcgtgacaccggtgtacaagaagggcgactcggtgatcttcgcagtcaacgatatgttcactgacgccgaactggatcagatgcgtgcacctggtaattctccagaaccactgccagagcttcctaccttgggcgagcttgggttggctgaaactgaagacgaggtagatcagacttattaccatcgtccaacggttcctgctggtgtgaactcagagatgccttcagccgaaactctgtatgcaccggatccaacgaagccgcatacggtccctaactaatcacaaagagtattcagtaaatcgaccgcagtcggtgaatcctagtttgcgataaacgggctcaccatcttcggaagcttgcaacacggcggtgtcacaccctgcgttacgtgcggtatgcaacgtggctaaggtgatggctccgccgtagccacgccggcgtttgtgctcaagggtggagatattgtagattccaactacgctcgcgtgtatgaatgcttccgcagaacacactgcgcggttgcccgcataacccaccagataaagtgcgggcgagttctttctcagtgcgtattcagctgcttcggtatagaaacgctgcacagtttcggcgggtggattccaattcgcagaaagaactgcagcgtaatctgccagctcttcgggagatttaaccacccggatctctaagccctcagcgcaagcttcgggcagcggttcggttaagtctttccacatgcctgtttctgtttcggaggcatttcattgggcctcaacgagcagctctccgatatttctagggctggatgcggggccgacccaccaggaaaacggacggagtgcatgttctacaaaagcggtggtttcagcaatccgcgcagctgcaatctcaggggtaaagcgtgcgcccgcaataatgttgaacgtgtcatcgtcgaggctactgtctgcgatgagcaggccatcggtgtgcgtgattgttgcggatgcaagatgccggtggagatggcagaaatgctccgctaagttctcttcgattgcgcgttgtaatttaccgaggtccttcataaaacttcattttaggtatcacaaaggtgccataagtcgcaccctttgttagactgcaaaactcgccttttggttccctcaaaagcaaatctgagaatcttcccactttcactagtcttatcccggaccagcgcactacagttcctggattaggggatgtaaagatctaaagctgggggaatacatggctgaaggcatgttgatgcccacgacatcggcgcaggtgtcggggcataaatttctggtgcggcgcatcgaacatgggttggtgatgggcgatgtgcgcatgattcatgatccacttggtaggcgccggcgggcgttggtgtttggggtggtggcgtgcgtgatgttggcggtgggatcattggcgttggctatttttcgacccgcgaaggatccggccgatgcgccgttgatccgctctgaatccggcgcgctctttgtgcagctggatgggtcggtgcatccggtggctaatgtggcctcggctcggttgattgtgggggagccggtggatccggtgaacgccagcgatgcgatcatcgcgggcatgccgcgcggagtgccggtgggggttcctgatgcgccggggcttttcagcagcaccgaagaacccgagcaagattggtttgtgtgccaggatgtcggcactggggatctacacattacggttcctaggggcggactagggcccaccctgattgcggaaggaaatgggtggctgggggcgtcgaaaagcgaaaccggcgaggtcacctggaacctgattaccgcggacgggcgccgcgaactgccggcgtggggcagcgaacatgggcgcattatgcgccgccacctggggatttccgaggacaccccgcgcgtatacctgaccactgagctgctcaacgcgatccccgagcacgacgcggtccgcttcccagccccgctgcccgagcttgtcgacgcctccacccgcaactggttacggctcgacggggcgctcgccgaaatcacgccgctacagcgcgggttgcttatcgacgccggttccggtgttttccccgaccccaccgcgcttcttggtgtgcatgaagaaacagccaacaccttgacgctgcccgagcaaacagtttcttggcaagatctggacggtggttttgcctgcgcggatggtgaaggccagatcggtttcctggaaactctggaatcgggggtggcgctatctggtgattccagggcgaaaagtttcagcacaaacgctggtggggcagtgggcgtggacagtggctttggctactatgtggtctctgattttgggctgatgcaccctgtttctactggtgaatcgatggttgccctaggaatcactgacgtgcaggtcgtgccgtggagcgtgctgcgattgttgccgcagggaagtgaattagcaaaagagacagcgctcgcgcccacctattaaggagtatggtggccttacatgagcggattagttgacccggatagtacttttttaaagaccatcggaaaactgagcaacagcttgtccattggtcgtggagtagatcaaaaagaggtaatccccaaaggctggaacgcccattgggaggcaattacaaagcttaagagaagctttgacgcgattcctgctggggagcgggtgcgtttagctaagaaaacctccaacctgttccgtggacgctccgatgcaggtcacggcctagatgtggcagcgcttgggggagtgattgccattgatccggtcaatgccaccgccgatgtacagggcatgtgcacgtatgaagacctggtagatgccactttaagttatggtctgatgccgttggttgtgcctcaactgaaaaccatcacgcttggtggcgcagtgaccggaatgggcgtggaatccacatccttccgcaacggtttgccacacgaatcagtgctggagatggatatttttaccggcactggtgagatcgtgacttgctcgcccacagaaaatgtcgacctttacagaggttttcccaactcttatggttcgctgggatacgcggtgcggctaaaaattgagctggaaccagtgcaagattacgtccagctgcgccacgtgcgcttcaacgatttagagtctttgaccaaagcgattgaggaagtcgcgtcttctctggagtttgataaccaacccgtcgattaccttgacggcgtggtgttttcacccacggaagcctacttagttcttggcacgcaaacctcacaacctggccccaccagcgattacaccagggatttaagctactaccgctccctgcaacacccagagggcatcacctatgaccgcctgacaatccgcgattacatctggcgctgggacaccgactggttctggtgttcacgcgcattcggcacccaaaaccccgtggtgcgcaaactctggcccagggatctgctgcgctcgagtttctattggaagatcatcggctgggatcgaaaatactccatcgctgatcgcctggaagagcgcaaaggccgcccggctagggaacgggtggtccaagacgtggaagttacgattgataaactgccagaatttttgaaatggttctttgaaagcagcgacatcgagccgctgtggctgtgcccgatcaagcttcgggaggtaccaggtagttcggttggtgctggagaaattttgagctccgctgaagcaatcgactccggtgctgctgaacacccttggccgctgtatcccttgaagaaggacgtgctgtgggtcaacatcggattctggtcctcagtgccggttgatctgatgggctccgatgcaccagagggagcatttaacagagaaatcgaacgcgtcatggcagagctaggcggacataaatcgctgtactccgaagcgttctacaccagggaagactttgaaaaactttatggcggaaccatcccggcgctgctaaaaaagcagtgggatccccacagccgattccccggtttgtatgaaaagacagtaaaaggcgcctaggatcgctcactgtaggtagaggcttgtggtcactacttgtggccacattttaaaaaaatgcacaagaagagaaagcaaagcattatgagtaacgccgtagcgcaggacctcatgaccatcgccgacatcgtcgaggccacgaccactgcacccatcccattccacatcactgccttcgatggaagcttcactggccctgaagatgctccctaccagctgtttgttgccaacacggatgcagtatcctacatcgcaacagcgccaggagatttgggtttggcacgtgcctacctcatgggagacctcatcgtggaaggtgagcatcccggccatccttatgggatctttgatgcgttgaaggagttctaccgctgcttcaaacgcccagatgcatccaccaccttgcagatcatgtggactctgcggaaaatgaatgccttaaaattccaggaaattccaccaatggaacaagcccctgcatggcgtaaagcactgatcaacgggctagcatccaggcactcgaaatcccgcgacaagaaagccattagctaccactacgacgtgggcaatgagttctactccctgtttttagatgattccatgacctatacctgcgcgtattatccaacgccagaatcaagtttggaagaagcccaagaaaacaaataccgcctcatctttgaaaaactgcgtctgaaagaaggcgatcgcctcctagacgtgggatgcggttggggaggcatggtccgctacgccgccaaacacggtgtgaaagccatcggagttacgctgtctgaacagcaatatgagtggggtcaagcagagatcaaacgccaaggtttggaagacctcgcggaaattcgcttcatggattaccgcgatgttccagaaactggattcgatgcgatctcagcaatcggcatcattgaacacatcggtgtgaacaactatcccgactactttgaattgctcagcagcaaactcaaaacaggcggactgatgctcaaccacagcatcacctacccagacaaccgcccccgccacgcaggtgcatttattgatcgctacattttccccgacggtgaactcactggctctggcaccctgatcaagcacatgcaggacaacggtttcgaagtgctgcacgaagaaaacctccgctttgattaccaacgcaccctgcacgcgtggtgcgaaaacctcaaagaaaattgggaggaagcagttgaactcgccggtgaacccactgcacgactctttggcctgtacatggcaggttcggaatggggatttgcccacaacatcgtccagctgcaccaagtactgggtgtgaaactcgatgagcagggaagtcgcggagaagttcctgaaagaatgtggtggactatctaaagaaacaatgtttctttttaaggttccctaggggcaggagttaattgtaggtaaactcgactagcaattagcgactgtcccatttcccacctgcttttgcggatttcaacactttcaggatgcatctgtaactatgcccatgccacaccccatgtttatcgatgtctccttcccacccgcggagacctgtagttaacccatgggcacgatgcgagaaatggtcagtgaccgcattgaccgactacaagaagcacacgcgcgatcaaagcagaagaagttcggcttcttagttcggccaggcaccctgatccttggatggttggtcacgatcatcggtctgatcaccattccacttcccggccaaggctggctgaccaccttcattggtgtgggcattttgtctctggagcttaaatgggcgaagaacctcctggcctggggagtgcatcagtatgatcgcttcttcacctggtacggcaagaaatcattccgcttccgcatggcgatgttggcactgatgattctgctgatttgggtggtgttcatcgtgacattttggttgatgtggcacgccggaactatcccgtgggcagatgagttcttcacctggcttgggttgagccgctagcaactattcgctttgaaggcgatccattaattcggagcgcctggaaaagatctcatccaaggcatgcgatacagattcctgagtcgtttgtgtagttggtttgggctcttgcggttgatgggattctgaacggtgcctcatagattaagtgataacacttgagctagctttttgaaaggccgagtgatgatgaattcggcgtagtcccatcagcacagctaacactgcgagcaacccaacaatgattgcggtaactaggatgccccgctcccgtggagaatcatccggcggcgtgggaacacttagtgcgatctcatgaaccaggggagtggtgggatagatttcttgagtaagtgccaggtagggatcaatagcgcctcttgcagggtcgatgctgttgaagattcgtgcacgaatttcatagggtgtggcaaagggaaaatgctggcgaagcagtgcagctgtggcgctgacaactggagcggcaaaactggtgccctcgaaggggctttcgccagcggtggtgatcatgtggctggcgaagccgtcgccacgcggtgatagaccagcctgaatgtggcttggtgcagagaggatttgttggttgccaggcatggaatattctgcaagcgtgtgagaatcaaaacgtgccgacacagagagcacagtgtctgaatgtgcaggataaacggtagatccaactggacaatcctgcccgaggtttcctgctgctgccaccactatcaccccttgaagttctgctctgttaagagcatccgtcagaggctggaacgatgcggcctcgtcgggtgattggggcaaacaggacaccacggaaatattgatcacgtgggcaccggaatcgagagctcggtggatggattccgccagggtgctcagcgttccgacgttggaatcttcacgagtacgcacatatgagctggtttgtttaatggagatgattccggaatctggggcgacaccgatataaggatcggagctgccgtcatatggccagccggtgccggggtttccttgggaggcgatgattccggcgacgatggtgccgtggccgtcgcaatcgataagttcacctggcacatcggggctttggtgggcgcccacgaaatcaccgccgggaattaagtggggcagacgtggatgcagggatactccggtgtcgatgactgccaccatcacaccggcgccagttgctagttggtgagcttgggataatgactgcgaaaggtgttcatctaaaactgcggaggaaggatcggcgatcgctacctcggggcaagcgagagcttctacttcctgtgccctcgtcgctggagtggaagccaacataaacagagcggccaagctaaccgcgatgagtctgcgcatcttatccaccgaatccaatatcaagaccgcgcagcattccaaatacatccagcaaatgcagtgcgagtggcagactagctgcaagacacagtgattccaacctttcaagccacacaatggtggtgggttccagcgtggggactgtactgatccacaatgccacgctgaccagcacagcgatgataaccacagaaccgatcagtgcaattagtgaacctgatcggcttgcggataacgccatggaaatgaaaccaagggcagataaccccatcaatgtccacgtgggaattggtgcttgatgacgattagcgtgaagcagcgaagccaccgcgatgcataaactaaaaacggtggttgtccaggtgcccggggtaaccgacaacaacgccaaaggcccgctcaaaacgccaaggccaaggatctgggcgtcgaaaagcgtctttgttgtttttattcttttctcgggatcagtcatggtgaggtcgctgacggagagatcttcgccggcggtgggaagcgatgggacgcgcaggcctgctagcgatgctgcgattttcggggcgaagcacatggtgatggtggaagcggtgaccgtgatcgctgctggaccgctgaaatcttcggtagctttgagcttccacagagtggtggttgctgcaaggactaagagaccgagccccaatgtggacagtgttgccaccagaagaattgctggacgatacaccacatgaaccagcagcgaactggcaagaatagtgcacgcgccagcgaaaatcgtccaggtaagcgcgccgggagaagtcccagaagtgcctgcaaccagcactgataccgctccgcctgcgcccaagatcagggtaatcggcaggacgtttcgaaggatcggggtgtgcgcgggtgggagccacagaagcagtagagcgcagattgcgacgaagattcccatgcggccgggcacaataattccggaggcagcaggacttgtcattaacacggcagccccgatgagccccgcgaaagtcatcaattccacgaggtgcccggcgcggttcgtggaagaaaactccaccaacgcttcggcgacatcacgcaacacgggggcttccaagtccctttcgggtgaaaggaccaccacgctgccttgttccacttgtgtttctgcaagcggaatcccgcaatcaatgggacttcccgcagcagtgtgagccacccacggcctggaaatccggggtgcatcggtgagttctaaaatttcatccaaaatgtccgccagactcgaacctgcaggtagcgccacatcagccacagcagcgggcgcatcgccaacggtgagatctatgcggatgctcacgcgcagcgcattatcgattgccaaaataaccaacccccaaaattgtcccccaacaaatgtgtctttgagtatgccagcaaaaggggacggggagcagcgttggtgagaattcccctaatttcacattcaagggaaccttttggccgtttttccagtcaaacacttattgacagccttttcttttttagatgactttctaaaaagcacgacactaggcaagacaagaagaactcgggggagttagaaaatgacaacatcagtggagcgacaagaacaatcaccaactggttacatcgtggaaccggtgacgtggccagaacgcgatccggcgccaccgctgccaacggagccgctgatcgctgaagctgtgccacaagcggtacgtccagcgccgaaaccactgctcaaagtattgatgcctgtgatcatggtggccatggtggccatggtgctggcgatggtggcgctgatgatccttaccagtgggcagttaaatcctatggtcttgatttttccaatgatgatgggtatgagcgtcctgatgatgttcgccccacctgaaggtgacgatactgatgaggttcggcgcacctatttacgtcacctgggtgcattgcgggcgaaagcgacagatcacgcggcgatgcagcgcaggcatgaatggcacaggcatcctgatccagcaaccttgtggtccacgttggggactcggcggatgtgggagcgcacccaagatgatcaagattgtttggaaatccgttttggtttgggcgtgaccaggcttgatccggctattaacgtgagtgattcgggtgcgccggaggatcttgatccggtatgtgcggtgtcgttgcgtcacaccattcgggatgtggggtcggtgcagagcatgccggtgtcggttcagttgcaggcgtttcgattcattgggctcaacggtgcgggcgcacatgatctggcgcgggcgctggttgtgcagttgttgtaccaccacggaccggaggtggtgggtatcaaagcgatcggggagtcgggttgggagtggctgaaatgggtaccgcacacccgcgatccggagaaggcagcctttcggattttgctggtggattccgtgttgaccaacggcaccgaaagcttcattgatgacccccaatggaccacgatcatcaacgttggcgcgcagaccagcaccgcattgggccagctggcagaggatgaagggctgctgttgcacgtcgataagcgtctgcatgtggctaccgcgcacggcgcggaggagctgggcacgccggatgcggttagcgctgagcttgcggaggtttttggccgccgtttgactgcttttcgacgcacaaccacagcacacgcggcgagctctggtgaattgctgtcccttttggggattgatgacgtggagcatttaactccagaaaccttatggatgaacaagcgcacgcagcctaaaactcgtttggcggtgcccttgggtttgaacgcgtccggtcggccgatggtactggatctgaaggaatcggcgcacggcggaatgggaccacatgggctgtgcatcggcgctactggcagcggaaaatccgaacttttaagaacacttgttctaggtttgacgatcacccattcgcctgaggaattgaatctggtgttggtggattttaaaggtggcgccacctttttgggcttcgagcagctgcctcacacgtccgcggtgatcaccaacttggaggaagagtccgtgctggtggagcgcatgcatgatgcgatttcgggtgagatgaaccgcaggcaagaagcccttcggcaggcaggtggctgcgccaatgtggatgaatacaaccagcgtgatggtgtgaaaccgatgcccgcgctgctcattgtgatcgatgaattctcggagttgcttggccaacatcccgatttcgcagacctattcgtcgccgtcggacgcttgggccgttccttacacatccatttgttgctcgctagccaacgtctggaagaggggcggttgcgcggattggattcccacttgtcctaccggatcggcttaaaaaccttttccgcatccgaatcgcgccaggtattaggcatcactgacgcatatcaattacccagccaacccggcgcaggtttcctcaaatccgacgtcgacaccgtcacccgcttccaagcaagttatgtatccggccccatcatgcgtcgccatcacctcgcaccaacgcagtcccgggtgcgcctttttaccagctgggaggaacccaaagaggaggtgattgtcgagcaaagcaccgagacgcttatcgacgccgtggttgcgcgcgccatcagcgccgcgaagttgcgggggttaagcgctcatcgcatctggttgccaccgttgccggcagaagtttcgattggtgctttggctgatgatgtcggtgagctaagcgccgtgatcgggatgatcgatagaccctatcaacagcgacaagatccattgctgattgatttttctctcaacggtggaagcggacactgggctatttgtggtgggccccaaaccggaaagtccacggcattgcgcagcatcgtgatctccatggcagcaacgcatagcacagaaaacatccgcttttacgtgctggatttatctggaacctccctggaaaatctctcccggctgcctcatgttgcaggcgtggcaggacgcaaagatccagagaaagtccgccgagttgtcgatgaagtacgaggcctgatcaaccaccctgaacaacgccacaccttccttattgtggacggctggcacaccatcacccaagaattcgacgagcttttcgacgccttcgtagacatcgccgccaacggccttgcctcgcgggtgcatttagttttaagcactcaacgctggagttccatccgccccgcggtccgcgatctggtgactggcagaatcgaattgaaactcggcgaagccatggattcggtgattgatcgtaaagctcagcttcggatcccgtcgaaacctgggcgtggcctcaacctggataaagaacacatccttattgctcatgcgtctggccaagacatcgcccaggtatgcgtcatggccgatgggcaaggatggcagcaggtcccacaattaagcgtgctgcctgcgcatatcctgcttcacgagcttgagctttctgcgacacctggcatcccgattgcacggggaggtgctgaactatccacgctgacgtgggatccagaatccagccgccaccttctagcttttggttctcaaggttgtggcaaatcctcgctgatccgcacgattgtcacgggtctgacaattgtggggcgggagaaagcacgcttggtatttttcgaccttcgacgcacccacctaggcctggtccccgaagacatgttggctgcttattgtgctacttccacagcagtccacaacaccatcaaagacatggtggctacgctatccgccagacttccaggacctgatatcaccgcccaagaactccgcgatcgttcctggtggcaggggcccgacatttatttagttatcgatgattatgatttgctccccgccggcaccctgcacccgctgcgcgagatcatcccgcatgcaagagacgtaggcctgcacatcgtgctcacccgcaaagccggtggcgcctcgcgtgcgctctacgatccggtcatgtccgagatcaaggaccaatcaccgcacgtcgtgcttttcgacgccgaccgcgacgaaggcgctatcctaggcatcaaacccacagcacaaccaccaggacgtgccacgatgtccatccgtggtgaaaacatcggtgttgcacagatggcacgcataggtgatgactcatgagcacccaaacaatcaccatcacagtcctagaaaccgccaccatctttgacggccctgaaaccatctaccgctatgacctggctgccgaaggcatccttgatggatgggctcactctgctgtgctggatcaagtgaaacaaatagcaggtgaaaactggccgactgttgagatcgtggtggatggcaccgacaacgtagtcaatgcactcacctccatgtttgcttccaaaggcgtgacctgcggtggggttggagtagaagcacctcccgttgcggaggaaccaccgaaaattaaacggcccacgagtggaaaacaagtccgccagttctacggcatcaagccactacacctgttgttggtcagcatattggttggttctattgctggtatttgggtgatttcgggtttcactgggccagtggactcacggccggtagataaggtggcggagatttcaacgcagggggagacgtcgataagcaatcaaccccaaccccagcccaccgtgctcgtgaccgaggacctgcttattgaggcgccatttggttttgaaatgcgaagcgacgaacagtcgcgctacctggaaggccccgacccgaatctgcgcatccacgtgggcgtcgatccgctgcacggcgcggacgccgcgctggttgccgaagagctgcgccgcctgatcaccgaggatccttcgctggaggaaattcccgcaggggagtggggcgagaaaaccaccatcgactaccgcgaaacacccggcgatggctctcatgtgctgtgggtgacctggtttgacaccgaccgacaactcaacgttgggtgccatagcaaagccgccgaaacccttgttcacaaggcacaatgccgaaatgtgattgagcatctgacgctgaaatgatgccggtttctatccggaatagggccggaataaaaaagttttgaaaaatagggaaccaaaacgcgactttcacagtccaacataaataggaaaggcaaaaagcttttccgggggaacaccagagaaactggtgaactttaaaatcatttcgttcgaggaggggcgaaccaatgtcaaatcttttcaggacagaatccgatgtgatgctcgcgacggcgagccaggtagacgacattaacgatcaagttcagggcgaactgagccgacttcgcggagttgttgattccgtacgcggcagctgggccggccaagcacaggtcagcttcgactccctgatgaaccgctggaactcatcagcacgccaactgcaggaagcactggcgtccatctctgacaacatccgccacaacgcgcgcagcttcgaaaacactgaagccgacaactcccaggcattcaacgctgtcggtgctggcgacggcgctggactcccactgtaaaactctcaaagaagaataaggaaccaagaacatggacatgatccgctatgaattcggtgccatccaaggtgccgcaaccgacatcaactccacctcaggtcgaatcaactctctacttgatggcctgaaatctcaactgcagccgatggtagccagctgggagggcgaatccagcgaagcatacagcgaggcgcagctgaagtgggaccgcgcagcagcagaactcaacaccatccttgccaccatctccaacaccgttgcccaaggcgctgaacgtatgtctgatgtgaaccgccgcgcagcagcaagctggggtgcataagggctagttgtaaaggctggctttgattgctagcggggttgctgcactttttaaaaaggcaaaaaatagcgaaaacacaccccaggtttttcccgtaaccccgctaggctatgcaatttcggtttaacccagtttttcaaagaaggtcactagcttttccgctggtcaccttctttttggtttttcaacgcagagatagtacactttactctttgtgtgtggagtcaaacctcccctttaaggggtgcgcttggacagcaggacaaattcgggtcaccaccggccgccgaatttagcttccttccgaacatattcctggctggcagttctagaccgactaattcaaggagtcattgtgtctacttaccacccgaagagcggtgacatcacccgtaagtggtacgtcatcgacgccactgacgtggttctgggtcgcctggcaacccacgccgctgacctacttcgcggcaagggcaagcctttgtacgcacctaacgttgactgcggcgaccacgtaatcgtgatcaacgctgacaaggttgcagttacctccaacaagcgcgagcgcgaaatgcgttaccgccactccggttaccctggtggcctgaagtccatgaccctgggtcgttccctggatctgcacccagagcgcaccatcgaggattccatcgtcggcatgatgccacacaacaagctcactgctgcttccgcaaagaagctgcacgttttctccggctccgagcacccatacgctgctcagaagcctgaggcctacgagatcaagaaggtggcccagtaatgtcagagcctatccagaacgagaacgtagagagcaacgtcgcagacgctgctgacatcgctgcagcaaccgctgcaaccgaggagttcaccaacaccatcggcgatgcaattgctactgcttccgaagaagagaccatcgaggctgcaccagtagtactcgacggcccaatccagaccgttggtcgccgtaagcgcgccatcgttcgcgtccgccttgtagctggctccggcgagttcaagtgcaacggtcgcaccctggaagagtacttccctaacaagctgcaccagcagctgatcaaggctcctttggtcctcctggaccgcgagaaccagttcgacatcgttgcaaccctgaagggtggtggcccaaccggacaggctggcgcattccgcctcgcaattgcacgtgcactgaacgcatacaacccagcagagcgcggcgagctgaagaaggctggcttcctcactcgtgacgctcgtgcagttgagcgtaagaaggctggtctgcacaaggcacgtcgtgcacctcagtactccaagcgttgatatttactcaacgtttgcgcaaacccgtttcgccgaatttctcggtggggcgggttttccgcattcttggggtttcttgtgacttagggacttgggtttacacagctcaaccgaagaaaaattgttcaatagagttttgaacaatgcgatcttggccaggccgtgcataattaatcgcatgactcgactatttggaactgatggcgtccgcggactagccaatgaagtactcaccgcacctttggccttgaagctgggggccgctgcagctcacgtacttaccgcagagaaacgggtagatggacgtcgcccggttgcgatcgttggtagggatcctcgagtctctggagagatgctcgcggcagcactttcagcaggcatggccagccagggtgttgatgtcattcgtgttggtgtcatcccaacccctgctgttgcattcctcaccgatgattatggcgctgacatgggcgtgatgatttctgcatcccacaacccaatgccggacaacggaatcaagttcttctctgcaggtggacacaagcttccagaccatgtggaagacgagattgagcgtgttatggacagcttgccagcagaaggcccaacagggcatggagttggccgtgtcatcgaagaagcaaccgatgcacaggaccgttacctagagcacctgaaggaagctgttcctacgtcacttgaaggcatcaagattgttgtggatgcagccaatggtgcggcaagtgttgtagctccaacggcttatgaggctgcgggtgcaactgtaattgctattcataacaagccagactcatacaacatcaacatggactgcggttccacccacattgatcaggtgcaggcggcagtcctgaagcacggtgctgaccttggactcgcgcatgacggtgatgctgaccgttgtttggctgtggacaaggatggcaaccttgttgatggtgaccaaatcatggcgctgttagccattgcgatgaaagaaaacggcgagctgcgcaagaacaccctcgtgggcactgtcatgagcaacctgggattgaagattgctatggatgaagccggaattacactgcgtaccaccaaggtaggagaccgctacgtgctggaagacctcaatgcaggtggattcagcctgggcggcgagcaatctggccacattgttcttccagatcatggcaccactggcgatggaactttgactggtctttccatcatggcgcgcatggctgaaaccggaaagtccttgggcgagttggcacaagctatgacggtgctgccacaggttctgatcaatgtgccagtttcggataagtccaccatcgtgagccacccaagcgttgtggctgcgatcgcggaagcagaagctgagttgggcgccaccggtcgcgttcttcttcgtgcttctggcaccgaagagcttttccgcgtgatggttgaggctggagacaaggaacaagctcgtcgtatcgcgggacgtcttgctgcagtggttgcagaagtctaattcacttcagtcacagcgcaacgcgatctgcggggtcgaacctgcccaaaggctacttatatcgaattaggcaggtttgacgcttgaggggccacatatagcatcaccaaatgtgcatatgtgacccctttttctcgcctgttaacttgctggtcaaggatccgtccccggggaagtgggaaatgctaaaatggaacgagcattcgcataatggtcataaattagcgcgaatattcgatcaattttggcggaaagttcagaaaatgatcgagaatttgcattgccagtcctgcgcaggactggaacacacatccttcgagaaaagtttccccaaattgggaacctaaacgcctttgagacagtcaaaccatagtggagggcaaaaatactgccacgaaactgacattggttgacacatcttaaaaagggggacttttaggtgtctggattcgaacttaaaattggggaatctttagcgacactgcgcgggcttctgggggaaaccgcgcagcaacacagcattcaccggcaacgcgtgccttactattcaccttcggcctctggccgaggatttagcgcgcacggcgtggccttggcggacatgtttgaggggctgcacaggggcgtcgagaagcgtatcgacgcttttacccaaacaacccaagccgccgaggaagaagttaaacgattcgacaataccgacaaagtttttggtgccggatttgatgggattgatccgaagtgaatgatcctttagccggctacggagcagtgatctccgcactacaaggcgccagtggtgggatgtatcgcggaccggcgaaatccgaaggccagttgcgcgagatgtaccaaaccatcgaagggctagacaccagctcgttgcgcgaagctgccgaagcagcagtgggcggaacgaacgaagccagaatacaagggtgggtcggcccgctcttgaaattcttcgggacggttggcgggggaatgatcgccacggagatagctgaacgggcagtcgattggttcaaaaaccgtaatgatgtggaagaagtcagcgaagccgctgataaagccgccgatgcgatcgactccactgtcacagagtccgaccagggcatgatgcacattatccagcagctcttggacattgtgtctacgttgacgcagattcttggcagcatggatcgggggaaatttcctcaagaattccgggactgtgtccaaactggagctgatcttattgaccaggcaggggacatgcttgaaggattgtgcgctgatcgagatgatgcgatttcacagtgtttctccgcgttgaccgatcatggaaaacaagtttgtgaaactgagccaaagccgttgtgtagtgcagcttctgggggttcatctggtggagcgacttcttcggctgcggcctcttcaggtggttcaagctcgagcactgctagctctgggagttctggcggatcgagcagtgctgcggatagttcgacgtcgaccaatgctgaatccagtgttgaaaaggaaaagaccacacctgctgccgttgagaaacctgacgagaaaccagtggagaagccggttgaaaagacgccagaaaagccggtagaaaaacctgtcgagaagcaagagtgtgaagaaaagcctgaccctgacccggaaaaatgcaaaacagagccggtcgagtgtgagccaacaccgaaacctgaaacagagcctgaaccaaaaccgacacccacgcccacacccggaacaccaacaccaatacctgagctagagactgaggattgtgaacctggcaaggagacgggcacagactcagaatctgaatcggaagagtgcgcccccgagctcaatgacgttccagaagagtcggatctgattgggcaactcatcaagggagcaatcggtattgggattgttgttgtaggcgttgggctgttggtgaatttcctggagcagtgcgtccctgtgattgaagaagtacctgtgccggagcccgagcctatacctgaacccgctccgcagcctgagccaacttcagtgaaaccaccagagtctgaactagataaggtggctgagcctgcgccgaagccaattccacaagctaattacactgctgctgcagcaactaactattccgctcccgcgcacgctcccgttgtcccaattacgccggcagcacctgaagttccggcagcaccagaagtgcctgcaccggcggttaatcttcacaaggccggcgggtggtagcggtggagtatgcggaatttctccagcagtttcgggagcgcacagctaagcggatggaagagttcgaaaaggcgatcgcttcgactcaacgaaagcttgatgatgtggcggaagaggtggaaaagaagaaacagcctgttgtggttgagtctctggaaaaaccgattcggatggcaaggcgacaacagagaggtcgggggcctgtgaaatcggtactgcgggaagcctaaaactagaaaggggtgattttggttggtacaaaaccgcaagaccgcgttagtaccaaacaaaatcacccactaagaaaagcgaactacttctcgttaaggaacgcgaatggggacgtgtccttagggaaggcatgttcctgcagctcctggccgaagtaggagacaactttcttagcttcagcgtctggttcggagaatgctttgtatttcttttctccggcaagttggtggagaaggaatccggtgaggaggccgcggacggtttcttgagctccggtttgtgggctgccgattcctgcgacaagtttgaacatggtgtcttcagagaagccctgttggttgcctttttctgattcgcggtagcagacatcgccggcccagttggctgcgagttttgctggctcgccggattcaaagaggccgaggctggaggatccgatgactaggcctggggctttgacagcgaaggcggcgtcgattgctgagggggaggttttcgctgggtagattgctccgactgcgcgcacgaggtcgcggtttgctgcggatagtactgcagccccagcacccatgccgtggcctactacaccgaggcaggctgggttgacggtgacgtttccggagccgagttttacgccgccgagaatctgaatggaggattcgaggtcagaggcgaaacctttgtggtctggcatgaagccattttcggtgtctggggcggcaacagcgatgccccaggacgcgaggtgtcgcaaagtttggtggtagtacttgatggatttcatccagtcgtggccgaaagctacacctgggatgccgtcgccttctgctggggtgtagattttgcccgggatgccggcgtagttcatatcgcctaccagcacgcggtgcggtccgcgcttggacagtttggacaggtgtttgttcagattctcagccacgtgtttaaggatagttgaaagcgtggggcaatactggcactaaccccggcaccaatcgtatttctgtccgcggttggtggcacaatagttcaacatgaacttgctgaccaccaaaattgacctggatgccatcgcccataacacgagggtgcttaaacaaatggcgggtccggcgaagctgatggcggtggtgaaggcgaatgcatataaccatggcgtagagaaggtcgctccggttattgctgctcatggtgcggatgcgtttggtgtggcaactcttgcggaggctatgcagttgcgtgatatcggcatcagccaagaggttttgtgttggatttggacaccggagcaggatttccgcgccgccattgatcgcaatattgatttggctgttatttctcccgcgcatgccaaagccttgatcgaaactgatgcggagcatattcgggtgtccatcaagattgattctgggttgcatcgttcgggtgtggatgagcaggagtgggagggcgtgttcagcgcgttggctgctgccccgcacattgaggtcacgggcatgttcacgcacttggcgtgcgcggatgagccagagaatccggaaactgatcgccaaattattgcttttcgacgcgcccttgcgctcgcccgcaagcacgggcttgagtgcccggtcaaccacgtatgcaactcacctgcattcttgactcgatctgatttacacatggagatggtccgaccgggtttggccttttatgggttggaacccgtggcgggactggagcatggtttgaagccggcgatgacgtgggaggcgaaggtgagcgtcgtaaagcaaattgaagctggacaaggcacttcctatggcctgacctggcgcgctgaggatcgcggctttgtggctgtggtgcctgcgggctatgccgatggcatgccgcggcatgcccaggggaaattctccgtcacgattgatggcctggactatccgcaggttgggcgcgtatgcatggatcagttcgttatttctttgggcgacaatccacacggcgtggaagctggggcgaaggccgtgatattcggtgagaatgggcatgacgcaactgattttgcggagcgtttagacaccattaactatgaggtagtgtgccgaccaaccggccgaactgtccgcgcatatgtttaagtgaatacgtttaaggagcagcaatgaaatctgagtttccggtatccggcacgaggcgttttgagcatgccgcagatacccaaaattttggggaagaattaggcaggcatctagaagctggcgatgtggtgattttggacggcccgctgggtgctggaaaaaccacatttactcaaggtatcgctcgtggattgcaggtgaaggggcgggtgacatcgccgacgtttgtgatcgcgagggaacaccgctcggaaatcggtgggccagatctgatccacatggatgcctaccgattgctgggcgaagacagcgaggatgctgatccgatcggtgcgctggactctttggatttggataccgatttggacttggctgtggttgttgcggaatggggcggtggcttggtggagcagatcgctgactcgtatcttttgattaccattgatcgagagaccgctgtgcaggaagacccggaatctgaggctcgaattttccattgggaatggcgcgaaggccgctgagaaagttttccacgctaaaatagtgtgattctgtccgaatctgttgttttagttttgaaactgcgggatcatggaaagtagtgaaaagtgaattttagttctgtgctttctctgccctttaagtgaaccttttgttggatcttgcattgaaaaaatgaaaacctcgtcgggaatgcaacttgggatcacgtctcgggcaagaaacgtccttaaaaaaaggggagtgattgtgagtgcttgatttcttagctgcgaacccgctgattgcgctggtggttattttggccgttggtttagcaattggtcagattagggtctttggcctttctttaggtgccgccgcggtgctgtttgtggccctggtggtttcaactgcaaataccgacatcgtcatccccatgattgtttatcagctgggcttggcgatgttcgtttatgtcatcggtttgtccgccggaccagcatttttcagtgagttcgctaaaaagggctggaagctcaccatctttatgctcctgctgctggcaacactgattggtttggcgtgggtgcttattaagtcactggggcttgatgcagcgatcggtaccggtatgttcaccggcgcgctgacctcgactcccggtatggcagcggtcgtggaattgattgaaggaatcgatccaagccttgccagtgaacctgttattggttattccttggcatatccgggagccgtgctgggatccattgtggtggccgcggttggagcgaaactgctcaaagtaaatcaccgggaagatgctcgaaaagaaggcatgatcaccgcaccgctggtgtggaagggtgtgcagctcaaacctggaatcacaggcagggtgggagatcttccacgccttgcaggtgaaagtatcatcgcaacccgcattgtggatgatccacatacacaccgcctcgcggatccagatctgccgattactgaaggcatggaactgttgatcaacggcactgaagaagccgtggatcgggcaattaaggcgttgggtgaagaacgcgaaaccaaaattgaggacacagagctgatctacacccgcctgacggtatctagccctgaggttgcaggtagaaccgttgctgagcttgatactgtagctcacggattcatgattgcccgtatccgccagggcgattctgaggtagtgcctaaacctgacaccgtgatcaactactctgaccgcatccgcgtggtggttgctcctggtcgtgtggctgaagtgcgacgattcttaggggactctgaaaagtcccttgctgatgttaatctgctgcctttagccatcggattatctcttggcctgttgttgggcgcgatcccgattcctcttccaggcggcaccacgatgtcccttggctttggtggcggcccgattattgccggcctgattttgggagcactcaagcacacaggaccgctgacgtggcagatgccgttccacgccaaccgcacgatctccaccttgggcctggcgctgtttttggctggtgtgggtacctctgcaggtgcaggatttagagctgcgcttaccgattcctcctccttgatctacatggccggtggcttggtgatcaccttggcctctgcgctgctgtgtgctgtgatcggcatgtgggtactcaggttgaggtgggatgaagccatgggtgttgccgctggcaccaccacaaatcctgcaattatttcctatctgaatgggcaaaccggaacggatcttgccaacaggggatatgccactgtgtaccccacggcgatgatcggtaaaatcctcggcgcgcagatattgttcttgctgctctaaggtgatttttgggcagtggtgggggtggtgtccacccctgcgcgtaacctgggaagcatgactaaaacacttggttcccttcagctggaagaaatcacgctgaccctccctctgactgaagatgtggccgatgaacgcaccattgatgtgttcgcacgcattgccacacgcgtcggtggggaagaccttccatatttagtattcctgcagggtgggcctggcaatgaagctccacgtccaagccttaatcccctcaaccccaattggttgggcgtggccttggaggaataccgcgtggtcatgttggatcaacgtggcaccggccgttccaccccagtgggtaatgatattttggaaaaacccacagcagaagtagtggagtacttatcccacctgcgcgcagatggcattgtgcgagatgctgaagccctgcgtaagcatttgggtgtgaatcagtggaaccttttaggccagtccttcggaggtttcaccaccctgcattacttgtcccggcacgccgattccttggacaacgtgtttattaccggcggtctcagcgctattgatcgcccagcagaagacgtgtatgccaactgttacaaccgcatgcgccgaaactctgaggaattctaccgtcgcttcccgcaattacgggaaactttccgagggttggttaatcgtgctcgcgccggggagattgtgcttcccaccggcgaagttgtgtcagaaaccaggctgcgatcccttggtcacttgttgggtagcaatgacggctggtttgatctgtacaacctgctggaattagatcccacctccaacgcttttgtccatgacctggcaggacttttgcctttcggcaaccgcaacccaatttattacgtgctccatgagtcctcttacgccgacggtgtggtgacaaattgggcagcagagcgtgtgcttccagaggatttccgcgaggatccaacactgctcaccggtgagcacgtgttccaggagtggacagacaccgtgccgtcgctcaagccgtggaaggacgttgccctggcattggctcagcaggaatggcccaagctttatgatgcgaaggcattggaaaactcacaggccaagggcgctgcagcagtgtatgccaatgacgttttcgtcccagtggattactctctggaaaccgcacaacacctgcccggtgtgcagctgtttatcaccagccagcatgaacacaatggacttcgtgccagctcaggcgcagtactgaagcaccttttcgatctggcccacggccgagaggtacgctgattcctcgtgttagtactagccctagacacctcaacccctgacctgatcgtcggcgtcgtcgactccgacaccggaaacacccgcgccgaaaccatcatcgaggacacccgcgcacacaacgagcagctcacgcccaccgtccagaagacgcttctcgacgccaacttgagcttttcagatatcgacgcgatcgtcgtgggttgcggcccgggaccgttcactggacttcgagtaggcatggtgtccggcgcagcgttcggtgatgccctgggaatccctgtctatggagtctgctcactcgacgcgatcgctcacaatattggtgcacgcaacatcccgcacgcattagttgccactgatgcgcgccgccgtgaaatctactgggcaacctaccgctccggcgaacgtgatcagggaccagatgtcatcgcaccagcaaacatccagatcagcggcgctgtagacaccatttcgattcctgagcacctggtggaaaaactcccagaagaactccagaatgtcaccatgcatagcggcaaacctgcccccgcaagcttggtggcagtggctgatttcagtgtggaaccacaaccattggttcctctttacctgcgccgcccagatgccaaagaaccaaaaccaaaacctaaatctgcagccatccccgaggtggatctttcatgagtgaacaattcgagctacgggaactccgcagggaagacgcggggcgctgcgccgacctggagcaaatcctgttcccaggtgataacccctggccacgtgatgtctttgccgtggagttttcccaccccaccaatttctacatcggcgctttcgacgaaggatacttggtggcgtacgcaggtcttgccatgatgggacctgcggatgatccagagtttgaaatccacaccattggtgtcgatccggaattccaaagaaaaggcttgggacgcgtactcatggatcaaatgatgcatgcagcggacagccacgacggtccagttttcttggaagtccgcaccgacaacgtacccgcgatttccatgtacgaggctttcggctttaaaaccttggccgtgcgcaaaaactactaccggccatccggagctgacgcctacaccatgcaacgcccacgcttgagcgatcgcaaagatcaacagacagacacagaggggacacccagctaaaccatgatcgttttgggaattgaaagctcctgcgatgaaacaggcgtaggcgtagtcaaacttgacggcgaaggaaacctagagatcctcgccgactcagtggcctcctccatgcaagaacatgcccgctttggtggcgtcgtgccagaaatcgcctcccgggcgcacctggaatctatggtccccgtgatgcgtgaagcgttgaggcaggcgggcgtcgacaggccagatgctgtggctgcaaccgtgggccctggtttggcgggcgcgctgctcgttggagccagcgctgcgaaggcgtatgccgctgcgtggggagttccgttttacgcggtcaaccacctgggcggacacgtcgccgtggccaatctggaaggtgaaactcttccacacgcggtggctttgctggtttccggcggacacactcaattgttggaagtcgacgcggtgggattacccatgaaggaattgggatccaccctcgacgatgccgctggcgaagcctatgacaaagtctcaaggctgttgggattgggctacccaggcggccccatcattgataaattggcgcgccggggtaatccagaggccattgctttcccccgcggattgatgaaaaagtcggattctcggcatgatttcagcttttccggtttgaaaacctccgttgcccgctacgtggaagctgcggaaagaaacggtgaagttatttccgtggaggacgtctgcgcatcattccaagaagcggtgtgtgatgtgttgacgtttaaggccgtgcgtgcgtgccgcgatgtcggtgcgaaggtgctgctgttgggtggaggagtggctgccaactctcgtctgcgggagcttgctcaagaacgttgcgataaagccgacatcgaactccgggttcctcgtttcaatttgtgcaccgataatggtgtcatgattgcagcgttggcggctcaaagaatccacgaaggtgcccaagaatcaccaatttcggtcggaactgatccttctttgtccgttgagaccccacaggtgttttaaacatttagtattagttccatgaaaccagtcttctccgttgaccaaatccgacgcgcagaaaacaccctttttgagcttcaggcagatccggatgagctgatgatctccgcggcatcggcggtggccgatgtcgcgttggcaatggtggacggccccgctccagcggtctccagtgaggagtcaatcctgctgctggtcggccccggtggcaacggtggcgacgccttgtatgcaggcgcgttccttgcagaagaaggccaccacgttgatgctttgctgttgggaaacggcaaagtccatcaatcagcattggcatattatgagtctttgggcgggcagatcatttccgattttccccctcactacctctaccgcctggtgattgatggtttgtttggcatcggtggtcggggagggctcaccccagagctggccagtttggtggagtctttttccgcttcaggtatccccattttggcgattgatgtgccgtctggcgtgcatgccgatagtggtgaactgccgcccggcgtgatggtgacggtggaaggatttgataatgatgcaccgatggcgcgtcagaaaattccggcacacattgacgctgatgtcacgatcacgtttggcggtttgagacgcgcccacgcggtcagtcctgcgtgtggtgaagtgctctgtgctgatatcaacatcgctggtggcggcggaaaatcgctgtccgctgagttgagtcaggtgcaggcagaagacgcgaccccgcagatgtttgcctccaaggcgtatcaacggaaagattcgctttttgagcgcgcgaatctcaaagctacggcgccacatatccataggatcggccagcactttaccgtgttgaacatggagcctggcccggatcatgataaatacagtggcggaattgtcggcattgttgcaggtagtggcacctatccaggtgctgctgtgctgtcggtgaaggcggctgtcagggccacaagcgccatggttcgatacgttggccctgcgttaaattttgtcatccagtcgctgccggaggtcgtcgcaacgcaatcacttgccaccgccggccgcgtgcaagcgtgggtgcacggccccggacgcgggctggaggctgagcaatcagccgagcttgcggagcttttgagccggcctgagcctgtgcttatcgacgccgacagcctctcattactccagctctcagcggagcttcggcaggcgttgcgcgagcgaaaagcaccaacggtgctcactccgcacaagggcgaatttgaacgcatcgcagcagaattacgctctgaaggcgtcgagattccccaagcggacaaagatcccattggtgctgcgcaagcgttagctaaagaatttgattgttgcgtactgctcaaggggaaatacaccgtcattgcagctcacgactttgtgcatgcgatcaacgctgggcattcctggttggctacacctggctctggcgatgtgttgtcaggtcttgtcggtgcacacttggctcaaagctacgcagaattaaaccgcttgccggagtttttccccgatgtgaccttgtctgattcggcgatttacacccagattgcacctgctgcgaccatccacgcggttgctgctgggttggccgcacgaaccgaatttgggtttgcgccgacctccgcaagtttgatcgctgatgccatccctgcagcgaccgccaaggtggatttgaagcgaattgtctagctctgcatgaattccgtatgaattcttttctttcaagtggccgagatgtgaagcgcacggttaattgagaggcatgacctacggatttcttgtcaacacagatctcacccaccgcgcgattgactttgatttagaaaacgctgcgaagttcctcggcggtgccgatgatggccgcgtcgctgtcgctttccaagaggatggcaccttgtacgccgctctctacagcgccagcgcaaaagatgagggtgccgcagcaaacccagtagcatcccttggccgcaacgccgctgctaccggtgatggctccttcttctctgatccgaccactgcaatctgtggccctgtgatcttcgtgggggccgaaggcgaagacatcacgttggatgaaattgagcgaattaaggacggcattcgcgccgctcgtaactaccgcgatgattatccagaggaattcaacctgtggcgcaacgctgtatataacctgcgtacggcttaaagtttggctgccatgtgaatttttagcaccctcaacagttgagtgctggcactctcgggggtagagtgccaaataggttgtttgacacacagttgttcacccgcgacgacggctgtgctggaaacccacaaccggcacacacaaaatttttctcatggagggattcatcgtggcaaacgtcaacatcaagccgcttgaggacaagatcctcgttcagatcaacgaagcagagaccaccaccgcttccggcctggtcattccagattccgctaaggaaaagccacaagaggcaaccgttatcgcagttggcccaggccgcttcgatgacaagggtaaccgcatcccactggacatcaaggaagatgacgttgtgatcttctcccgttacggcggcaccgagatcaagttcggtggcgtggagtacttgcttctctccgctcgtgacatcctcgcaatcgtcgagaagtaggggataagttcatggcaaagctcattgcttttgaccaggacgcccgcgaaggcattctccggggcgttgacgctctggcaaacgctgtcaaggtaaccctcggcccacgcggccgtaacgtggttcttgataaggcattcggcggacctctggtcaccaacgacggtgtcaccattgcccgcgacatcgaccttgaggatccttttgagaacctcggtgcgcagctggtgaagtccgttgctgttaagaccaacgacatcgctggtgacggcaccacgactgcaactctgcttgctcaggcactcattgctgaaggcctgcgcaacgttgctgctggcgcaaacccaatggagctcaacaagggtatttctgcagctgcagaaaagaccttggaagagttgaaggcacgcgcaaccgaggtgtctgacaccaaggaaatcgcaaacgtcgctaccgtttcatcccgcgatgaagttgtcggcgagatcgttgctgcagcgatggaaaaggttggcaaggacggtgtcgtcaccgttgaggagtcccagtccatcgagactgctctcgaggtcaccgaaggtatttctttcgacaagggctacctttccccttatttcatcaacgacaacgacactcagcaggctgtcctggacaaccctgcagtgctgcttgttcgcaacaagatttcttccctcccagacttcctcccattgctggagaaggttgtggagtccaaccgtcctttgctgatcatcgcagaagacgtcgagggcgagcctttgcagaccctggttgtgaactccatccgcaagaccatcaaggtcgttgcagtgaagtccccttacttcggtgaccgacgcaaggcgttcatggatgacctggctattgtcaccaaggcaactgtcgtggatccagaagtgggcatcaacctcaacgaagctggcgaagaagttttcggtaccgcacgccgcatcaccgtttccaaggacgaaaccatcatcgttgatggtgcaggttccgcagaagacgttgaagcacgtcgcggccagatccgtcgcgaaatcgccaacaccgattccacctgggatcgcgaaaaggcagaagagcgtttggctaagctctccggtggtattgctgtcatccgcgttggtgcagcaactgaaaccgaagtcaacgaccgcaagctgcgtgtcgaagatgccatcaacgctgctcgcgcagcagcacaagaaggcgttatcgctggtggcggttccgctttggttcagatcgctgagactctgaaggcttacgccgaagagttcgaaggcgaccagaaggtcggcgttcgcgcactggctactgctttgggcaagccagcgtactggatcgcctccaacgcaggtcttgacggctctgttgttgttgcacgcactgctgctctgccaaacggcgagggcttcaacgctgcaactttggaatacggaaacctgatcaacgacggtgtcatcgacccagtcaaggtcacccattccgcagtagtgaatgcaacctctgttgcacgcatggttctgaccactgaggcttctgttgttgagaagcctgcagaagaagcagccgatgcacatgcaggacatcatcaccactaaagttctgtgaaaaacaccgtggggcagtttctgcttcgcggtgttttttatttgtggggcagaagtgctggttagagttactgtgcaaaagagctctgcataagaataaagacccggtctggtgaccgggtctgctcttttaaactgctactggttgcttgcgctcgttgttgcgaaggataaccagtcgttcggactctgaaagtccgccccatactccataaggctctgctacagctagtgcatgcttgcggcaggattccaatactgggcatgctgcacagatggcctttgcgcgcagctcccgacgctggcgagcacgaccgcgctcgccgtccgggtgatagaacacgtcggaggtctcgccgcggcacgttccgtgcaactgccagtcccagaagtctgcatttggcccgggaagctggtgaggcaatgtcatcttcaaatactccctattgtcagctactttttatagctttgatcgcgttctctgatgtggggtgttcgcccgagacaacagtgtcgaccgcaatgatgaacagattgtgacttgttagtgaagcaaagctgactaaatggccatatgcaggcgaactcctgctagtacgcccgttctgacctgcggttatgtgtcgaggtgaatctccggtgaattcttatagataacttgtttttgcaggtcaggacggggttaaggggatgggtgttatctgtcagtatgtgaggagatcaaggtgttgggggttctagttgctaagatggtgaaaacccgtgaggccaaaatccaactgggtgaattacccctgcataaatgcatgagggctttatacttgtcttattattaaacttttagggttttgatgcaggaaggtgcgagaacttggctgatactgagcgcgagctcgctgacctggtaccgcaggcaacggcgggcgatcgtcgggcattgcaaagaataatggagattattcaccccattgttttgcgttatgctcgcgctcgtattggaggtggacgccagccaacggcagaagacgttgctcaagaaatctgcctggcggtagccacctccattaggaactttgtcgaccagggtaggccgttcatggcgtttgtctacggcattgcatctaacaaggtcgcagatgctcacagggcgatgtcgagggataaatcgactcctattgaggaagtcccagaaacttcaccagatacttttacccccgaagactttgcgctggtcagcgatggaagtaacagagttagggaacttctcgatctactgagtgaaaaggcacgcgacattcttatcttgagagttatcgttggtctttccgcagaagaaactgcagagatggtgggcagcaccccaggtgctgtacgagttgcccaacacagggcactcacgacacttcgaagcacacttgagcagcaggagaacaagtaatgactcgacgtctacatggtggtgagcaggatggccaggaacacgttaaaggacagctaaagcagctgttcgacgacgacgcgttcttgactgacctgtcccgcggcgttgatccctcagagggcgatgacgccctcgctggcctcctcctcgatttaacaaaggaagctcaggagccgccggcaacaatgccggattggtctactttgctccctggaattttggatcaggatcaggatttgccagtggaatccacttcggacaccacggttatgcaggcatcaaaccctgcaacccaagaattcgcacctgtttctatttctgatacccccaacactgcaactaattcagctgatgcagatgagtccgcaactgttgttccacttgcagcacgccgtgagaagcgtgccaagagcggatcaagcggggttcattcactggatgcttcggcaacccagcgcaaatctcacccattccttagcggtttggtgggtgctgcagctgcaactctagtcatcgcaggcggtggagcagcagtgtacaacgctgatgaaaactccccgttgtatggcatgaatcagcagctgtttggcaatcaagattctccaagcgtggtggagcttgcctccacgctggaagaagttgatagtcgtacagctagtggcgatgtggaaggggcacgtgctctactcgagcaggctcgagcaatgctggatggcatggcacctcctcgaaaggcgccgtcggaggcaacccgaacggttgaatctgaaccaggtactcagacgttgactgcaacggttactgaatccgcaagtccggaaccaccggtcacggaaactcaaactgttacctccaccgaggtacagacagtgacaaccactgcggttgctccaccggtctggactcctaatccagagccaacaaccacagctgccccgacttctacgccttcaactggtggcggtgagggaaccggcaatgatggtgactctggacttgtgccacctcagactcctggaaactaggtaaaaatataaaaactgctagcaacgtatctttagttgctagcagtttttatttggcttcaagtccgtctaggtaaccaatgcagtagtcccacggcacataggcatcaatattgggttgcgcacttggttcatgcacggggctgagttccccagccaaggtggcgcgcatgtttgctgccatgatgtcccagtcgtagtagtggaactcttcgcagtcttcgcacatgaagaacacgccttcgattcctcggggacctaaaacttttttaaattccatcacgaggcgaaggtcttggctcacgtggattcgctcttcttcagaaagcggttcgggatgatcataagggtcatcgtcggtaataaacgatgccgggtcattgggatcatcggcaaacgggtcgcggggcatcatcgcatcaaagttcacatcttccaccctattggcagaggttgctaaaacccaatacactgccagatttccggttgtggaatagcgtgtgagctgcagcggttatccgatttaaggacaagctactaaagtttagataattgtggacacactatgaggaggaactgtcgcacatgacaacccagagccgagtttctaccggaggagacaacccaaacaaggttgcccttgttggattaacctttgatgacgtacttttgcttccagatgcgtcggacgttgttccttcagaggtagatacctcgacgcagttaacacgtaatattcgccttaacacccctattctttctgccgcaatggatactgtcaccgaggctcgcatggctatcggcatggcacgccatggcggcattggtgttttgcaccgcaacctgtctattcaagagcaggcagaaaacgttgagctggtgaagcgttctgagtctggaatggtcactgatcctgttacctgtactcctgacatgagcatccaagaagtggatgatctgtgtgcacgcttccgcatttccggtctgcctgttgttgatgaggccggaaagttggttggtatttgcaccaaccgcgatatgcgttttgaaagcgacatgaaccgtcgtgtcgctgaagttatgaccccaatgcctttggttgttgctgaagagggcgtcaccaaggagcaggctcttgctttgctgtctgcaaacaaggtggagaagcttcctatcatcgcaaaggacggcaagcttgtcggtctgatcacggtgaaggacttcgttaagactgagcagcacccgaacgcatccaaggatgcatcaggtcgtctgctggttgcggctggcatcggcacgggcgaggagtcattccagcgagctggtgcgcttgccgacgccggcgtcgacattttggtcgtagactctgcacacgcccatagccgtggagttttggacatggtgtcccgcgtgaagaagtcgttccccaaggtcgatatcgttggcggcaacttggcgacccgcgaggctgcgcaggccatgattgaagctggcgcagacgctatcaaggtgggtattggcccaggttctatttgcaccactcgcgttgtcgcaggtgtcggtgcacctcagatcactgcgatcatggaggcagctgttccagctcacaaggctggcgttcctatcatcgccgatggcggcatgcagttctctggtgatatcgctaaggctttggctgctggcgctaactccgtgatgctgggctccatgctggctggtaccgctgaggctcctggtgagaccatcaccatcaacggcaagcagtacaagcgttaccgcggcatgggctccatgggcgctatgcagggccgtggacttagtggtgagaagcgttcctactccaaggaccgttacttccagtctgacgttaagagcgaagacaagctcgttccagaaggcatcgaaggtcgcgtgcctttccgcggtcccatcggagacatcattcaccagcaggtcggtggacttcgtgcagcaatgggctacaccggttcctccaccattgaagagctgcacaacgctcgtttcgtgcagatcaccagcgcgggtctgaaggaatcccacccgcaccacatccagcagactgtggaagctcctaactaccactagattttgctcacttaaacagcccgatttcttcattgaaatcgggctgtttctggttgtgtcgcgtatctcgggtaaagtcttcgtcgtatacgaccatttaagggaggcccgtcacaatgcgtgaccacgttgaaatcggtatcggccgtgaggcacgacgcacctacagcttggacgatatttctgtcgtttctagccgccgcacccgttcatccaaagatgtcgacaccacttggcatattgacgcctacaagtttgatctgccgttcatgaatcacccaagtgatgcattggcaagccctgagtttgtcattgaaatgggcaagcagggtggccttggcgtgatcaacgctgagggtctgtggggtcgccatgctgatctcgatgaggcgatcgcaaaggtgattgctgcgtatgaggaaggcgaccaggctgcagccactcgcactcttcaggagctgcacgcagcgccactggatactgagctgctgagtgagcgcattgcgcaggttcgtgattccggtgagatcgttgctgtgcgcgtgtctccacaaaatgttcgtgagatcgcaccaatcgtcatcaaggcaggtgctgatctgctggttatccagggcaccctgatctctgcagagcacgtcaacaccggtggagaggccctgaacctaaaggaattcatcggttctttggatgttcctgtcatcgctggtggcgtgaacgattacaccaccgcgttgcacatgatgcgtaccggtgctgtgggcatcatcgtcggtggcggcgagaacaccaacagcctagcattgggcatggaggtatccatggccactgcgattgctgatgtcgctgcggcacgtcgtgattacctggatgagaccggtggacgttacgtgcacatcattgcagatggaagcattgaaaactccggtgatgtagtcaaggctattgcctgtggcgcagatgctgtggtgctgggttcaccgttggctcgcgctgaagaagctgctggaaagggctacttctggccagcagtggcagcgcaccctcgtttcccacgcggtgtggttactgagtccgtggacttggatgaggcagcaccaagcttggagcagattctgcatggtccgtctacgatgccgtggggtgtggaaaacttcgaaggtggattaaagcgtgcgctggctaagtgtggctacaccgatttgaagagcttccaaaaggtaagcctgcacgttaactaggtgtgtgtactcgcctcttcgcgttgcattttgagtggaggggcgcgtcgacaagcatctttttaggctcccacgtgacgccgatgctggccgcgatgacaaggatgatcgcggcccacttgagcgcggtgggggtttgatcaagcaggatccagccgacggcggcggcgaatgccggttcgaggctgagcagaatactgaaaatgggggcggggagtcggcgcagtgccgataattccagcgaataggggataagcgacccgagaagtgctgtgccaagcgccaggatgagtagggttggggtctggaaaatcgggcccatgtgtgtagcacccagtggaaatactgccactgcgccgataatcagtgcgacggccaggccgcttgttccggggatgagttggccgattttctttgatgccaggatgtagcacacccagaagattcctgcgacggctgcgaaaatgacgccgagtgggtcaagggtttcgccgctgagggaatcgatacccagtagtgccatgccgagaaacgctaaagccacgcacaatccgtttttcagcgtgcgggctaacaccgcggagaaaatcagggggccgaggaactcaatggtcacggcggtacccagcgggatgagttcgatggatgcgtaaaacaggctgttcattccgccaagagataatcccaacagcagcacggcgatccattgttttttagtccaggaacgaagtcgcgggcggatcaccaggcacatgatcaagcctgcgatgaacagccttaaagaggtgacagcccaggggccgttgagggggaaaagctgcgttccaatggcagcaccaaattgcagggatagggcggaacccatcaccatcaacactgcagcggactgtttattcatgcccttgattattgccaaagaaacctttaaggactagatcgaaaaacagccaactatagttaagtaatactgaacaattttggaggtgtcgtgctcaatctcaaccgcttacacatcctgcaggaattccaccgcctgggaacgattacagcagtggcggaatccatgaactacagccgctctgccatctcccaacaaatggcgctgctggaaaaagaaattggtgtgaaactctttgaaaaaagcggccgaaacctctacttcacagaacaaggcgaagtgttggcctcagaaacacatgcgatcatggcagcagtcgaccatgcccgcgcagccgttctagattcgctgtctgaagtgtccggaacgctgaaagtcacctccttccaatccctgctgttcacccttgccccgaaagccatcgcgcgcctgaccgagaaatacccacacctgcaagtagaaatctcccaactagaagtcaccgcagcgctcgaagaactccgcgcccgccgcgtcgacgtcgcactcggcgaggaataccccgtggaagtcccccttgttgaggccagcattcaccgcgaagtcctcttcgaagaccccatgctgctcgtcaccccagcaagcggcccatactctggcctcaccctgccagaactccgcgacatccccatcgccatcgatccacccgaccttcccgcgggcgaatgggtccataggctctgccggcgcgccgggtttgagccccgcgtgacctttgaaaccagcgatcccatgctccaagcacacctcgtgcgtagcggcttggccgtgacattttcccccacactgctcaccccgatgctggaaagcgtgcacatccagccgctgcccggcaaccccacgcgcacgctctacaccgcggtcagggaagggcgccaggggcatccagccattaaagcttttcgacgagccctcgcccatgtggccaaagaatcttatttggaggctcgtctagtagagtgagttcttgtgagccttcagacaaatcatcgcccagtactcgtcgttgacttcggcgcacagtacgcgcagctgatcgcacgtcgtgtgcgtgaggccggcatctactccgaagtcatcccgcacaccgccaccgcagacgatgtgcgcgctaaaaatgcagcagccctcgtcctttccggtggcccatcctccgtgtatgccgagggagcaccatcccttgacgctgagattcttgatctcggattgccagtatttggcatttgctacggcttccaagccatgacccacgcgcttggtggcaccgttgccaacaccggtaagcgcgaatacggacgcaccgacatcaacgttgccggtggcgtcctccacgaaggcctcgaagcctgccacaaggtgtggatgagccacggcgacgccgtctctgaagccccagaaggtttcgtagtcaccgcgtcctccgaaggtgcgcctgtcgcagctttcgaaaacaaggaacgcaaaatggctggcgtgcagtaccacccagaggtattgcactcaccacacggccaggcagttctgacccgcttcctcactgagatcgcaggtctagagcagaactggaccgcagcaaacatcgctgaagaactcatcgaaaaggtccgcgagcagatcggcgaagatggccgcgctatttgtggcctatccggtggtgtggactccgctgttgccggtgctttggtgcagcgcgccattggtgaccgtttgacctgtgtctttgttgaccacggtctgctgcgtgccggtgagcgcgagcaggtggaaaaagacttcgtcgcagcaaccggcgccaagctggttaccgttgatgagcgccaggcattcctatccaagctggccggagttaccgaaccagaagcaaagcgcaaggctatcggcgctgagttcatccgctccttcgagcgcgcagttgccggtgtgctggaagaagctccagaaggttccaccgtggacttcctggttcagggcaccctgtacccagacgtcgtggaatccggtggtggatctggtaccgcaaacatcaagagccaccacaacgtcggtggactgccagacgatgtggaattcaagcttgttgagccactgcgtgacctcttcaaagacgaagtccgtgccgttggccgtgaacttggcctgcctgaggaaatcgttggccgccagccattcccaggaccaggacttggtatccgcatcatcggtgaagtcaccgaagatcgcctagaaaccctccgccacgctgacctgatcgcccgcaccgagctcaccgaagccggacttgacggcgtgatctggcagtgcccagtagtcctcctggcagatgtccgctctgttggtgttcaaggcgatggccgcacctacggacacccaatcgtgctgcgcccagtgtcttccgaagacgcaatgaccgccgactggacccgcctgccatacgaggttctggagaagatctccacccgcatcaccaacgaagttccagatgtgaaccgcgtggtgctggacgtaacctccaagccaccaggaaccatcgaatgggagtaggccttaaatgagccttcgttaagcggcaatcaccttattggagattgtcgcttttcccatttctccgggttttctggaactttttgggcgtatgctgggaatgattctattattgccaaatcagaaagcaggagagacccgatgagcgaaatcctagaaacctattgggcaccccactttggaaaaaccgaagaagccacagcactcgtttcatacctggcacaagcttccggcgatcccattgaggttcacaccctgttcggggatttaggtttagacggactctctggaaactacaccgacactgagattgacggctacggcgacgcattcctgctggttgcagcgctatccgtgttgatggctgaaaacaaagcaacaggtggcgtgaatctgggtgagcttgggggagctgataaatcgatccggctgcatgttgaatccaaggagaacacccaaatcaacaccgcattgaagtattttgcgctctccccagaagaccacgcagcagcagatcgcttcgatgaggatgacctgtctgagcttgccaacttgagtgaagagctgcgcggacagctggactaattgtctcccatttaaggagtccgattcttcagttgagtagatgcctccaagtgaggctgggaggctcttagaatcgattctgagagggcactttttatcggccctggggtggaatttttgattgtttttgcaaaaccagacaggcgtgccaaaggtcctcaaaaatctgaatctttggcacgtgtgtttggttatggggacttggaaccagacaggcgtgccaaaacttcaagcaaaaggaagttcttggcacgcgtgtctggttttgctaaatcgactactcacatagggtcgggctagtcattctgatcagcgaactccaccttcacatcgccgattccagaatttacaaccagattcaacatcggaccttccaaatcagcattgtgggcggcgaggtctccaacatcacagcgcgctgtgcccacaccggcggagcaactcaagcttactggcacgtcatcaggcagggtcaccatgacttcaccgatacctgaggtgatttgaacgttttgttcctgatcaagttgggtgaggttgctgaaatctaggttcatttcgcccacaccagaggtgtagctgctgaggagttcatcgttggtggggatgagattgacatcgccgattccagggtcgtcttcaaagtagatgggatcgatatttgaaataaacaggcctgcgagggcgctcatgacaactccggtaccaactacaccgccgacaatccatggccacacatggcgctttttctgaggcttttgtggagggacttgtacatcccaggtgttgtattggttttgggcaagtggatcccaatgaggcgcttcgggggtttgttgcgcgaagggtgcatagtagccctcaacgggggtgatagtgcttagatctggttggggtcgtgggtagagatcttcgtttttcatggtggcatcctcagaaacagtgaattcagtggtgagtagtccgcggggtggaagtggttgtttcttatgcaacgcccaccacatggctaaaaggcaaaggtaagtaatggctgctgctgggccggatattcctccagcgccggaggataaaacacctgagaacataaagaacgcgatgaccagccaccagccgtggttgcggtctttggtgtggcccggggtccagagagcttcgatgggggagaccggaacggagtagcggggcatgcacagccatgcaatgagataggctgcgacaccggcgccgaagacaccagtgaccacgaaaaatagacgaatgagcaccgggtcgatttgataacgcacaccaatgccttcacagacaccagctactttggcgtgaccaccttgcttggcagggatgcgtgcggggcgggtctgccacatttgctgaaaagtaccagttgcaaggtgtggtgttggagcttcataaccaggttgggcaaaagggatgaatccctggttgtggtggggctcctgaaaagtactcatagactctattgtggagtgttgaggctgataagtgaatgggggaaagccctgaaaaggtggcgttcagggtcttccctgatggtttggtgtcgcaggggcatgacatgatcgaagatatgagtaacacacctgcgccttataccccgcagcctgcggggcaagcggtgcctttatatcccacgtttacccggtcaagagatggtcgggttgttgcgggtgtcgcatcggggctggcaaagcatcttaatgtgtcggtgttttgggttcgtgcgctgctgatttttgcggcgttgctgagcggtgcgggtctttttgcgtatgccttgatttggatttttacgcgcattgagaaaaaggggagtggggaggcgtcgacaagcaagcgctgggtgtcgtggtgcctggtgctgctcgctatcggtggtgctgcggcgtcggtgatgctgagcaccggcttcgcggtgggcacgttggtgcccatcggcgtggtcggtgtgggcctgttgatggtgtggctggcgtatgaccgcggggtggaatccggcccgaatctgctgattattgccaccggcggtgtgttgatgctggtggcgatcgtgctgatcgtgatgaattggaacacccaggacggcttcgtcatggcgctggtggccgtggtgctcacgctggtgggtgtggctgcgctgggcgttccgctgtgggtgcggatgtgggatcagctgggcgaggagcgcgcggaaaaagccgcagctgctgagcgcgcagatattgcttcccgcctgcatgattcggtactgcagaccttggcgctgattcaaaagcgtgccgacgaccccgccgaagtcgcccgcctggcccgcgggcaggaacgcgagctgcgtcaatggctgtttgattcccaagataaaacacctcaaacaaccggcactgtctttactgcgttggagcgcgcctgcggtgaagtcgaggatatttacgctctgcgtatcgtgcctgtgaccgtgggaaccgatgaagcgctgactgagaaaacgcaggcagcggtgatggcagtccgcgaagcactcgtgaacgtggccaagcatgccggcgtggaaaccgccgatgtgtacgccgaaattatgctcggcgaactgaacattttcgtccgcgaccgcggtgcaggattcgaccccgacaacatccccgacgggcaccacgggctcgccgaatccgtccaaggccgcgtcgaacgagccggcggaaaagtacgcatcaaatctgaaatcggcgaaggcaccgaagtggcaatcaccatggatgtgtagttggtcgtacgcgcgtgtcttcggggctgtaacctgaaaggcatggttgatgtgtttttggtcgatgaccactccgtgtttcgctccggcgtcaaagcagaactaggcaacgccgtcacagtagtcggcgaagcagggacggtggccgacgccgtagccggcatcaaggcaagcaaaccagaggtagtgcttctcgacgtccacatgcccgacggcggcggcctcgcagtgctccagcagatcaacgactccgatgtggacaccattttcttggcactcagtgtctctgatgctgcggaagatgtcatcgccatcatccgtggcggtgccaggggatacgtgaccaaatcaatctccggtgaagaactcatcgaagccatcaaccgcgtgaaatccggcgacgcattcttctcaccacgcctggcaggcttcgtcctcgacgccttcgccgcccccgattccgcagctggcgcaggcattgtcgacgcacccgaaaaagacgccgccgtagaatccggaaaaatcctcgacgacccagttgtcgacgccctcacccgccgcgaactcgaagtcctccgcctactagcccgcggctacacctacaaagaaatcggcaaagaactgttcatttccgtcaaaaccgtggaaacccacgcctcaaacattctgcggaaaacccaacaatccaaccgccacgcgttgacccggtgggctcactcgagggatcttgactaatggcggctaaaaagagtggcgctggttctcggggtggggctgggaggtcagcttcggctgataaacagatcgatcaaagccaagcgaaattcaccttccaacccacccgaacactgctgttcagtgttattttcaccgtcttggtgatgtggcaatccggtttctcatactggtacgcgatccctattttgttcttcatctgggcgattttcatcctcggccacagcttctacaactgggcaaacctcaagttgatcgaaatggggcgccgcaacaaacaggtcctagaagaacaagaaaagcagaaaaagaagaggggcttctaggctctgtttggggttgagctgtagtggagcggactgcttaggtcgatttcctgggtggtccgtttaggtgtttcggcgggggccttcagcgaacgccagcttccggctgccatccacgtgggggaacgttaaatacatccagccggtagctgccaggaacactagaatcgttgcccacaatggcgctcctgaaataatcggtgcaagcatcagcgccagccatgtgaaaaatagtggcatcacctggccaatggtggggactggtgaaatattgttttggaagcggtacatcctcatctccccacggtaaggatgcgcaaaagcgatgagcagcgcgagtgccagaccaactccagtgacagaaaactttacggccggggctagatcagtggttaatgaagcgatggcagcacctactaataccgagctactcagccgcacgctcaccggcgttggaattggggtgacgtgggacttcatggtgttgtagctgttcatcggatccataatttctaagagtatcgccttcccaaaacccatgctgcaggagtgcactctttgattttagatttatggcccatagacccattgtccgcctgagcacatcattatatttccagaagcatcttgcccaccggcctcgtatccttcgcatgccccacccggtgtagcagtcccgactccgagaggttctgggccgtagacccagattgggttgggggttcctgcataaatgcagaccaaagctgaaccatctgcagcttgacttggctgctggagcatcgagacagggcaagaagcgccataagcaggtaccgcaggagcaggggctacaggagtttcaatggtgttttgtgagatcacagtttcctgtactggagtttgctgaggggtgctcggatcgattgctgcttcgtctcgcatagttgattcagtagctggctccgaattactcaaatcattgagtgcaatccaagttagtttcccatcaccgagctcactatgtgtgaatccaaatcgctccgcagtggcatctttagggatttgaaatacccaagtcattggtgcgtcgaaaccggatcctagattatggttgcattccgggtttcctgggatgaggaataaatcgcgtattggttggtatacggcctcttgattagtggagatttctgcatagacagttgaaccagtggatgcacaggtgatgtccatatctgctccactctcgttctttatagtggtttcgactacgacaaagattccgtcttctctagacatctcgggttggatgtcgccagaaggtctgtctagggattccatttctacagagtctgtcgtgaaggcagaatcgatagtgatcgtcacgccgtctgctgatactgcggagttcatttcaggcagagtcgaggttgttttcgttgcaacactagacactgtcgtctccgatatagcggtatcttccgtagtagagcaggaagatagccctaggcccaaggcgattaatgctgtggcgaaagcacgggagcgtttagacatgattcgacttttcctcagcctttatttgatttcgtttcgagtaaaaattaaatctagcaggtttcattttcatggacgttgaaatggtttttgaaaagtagataaggggataagcctttgtttggggcagctgtggatttttcacaaccaccccttttctcacaccagccccgcatgaacaggctggttgcacaccgttgaaaatgagtgtttactggaactcatgagtggaacaggtgttcgaaagttgtggggagatggcactccggtgtcgctccctgacctttcaggattaagtagagcggagcgcattgatgcgttgcgttcacgcatgtccaccatgggtgctgcggtgccaaagtttgagccgtcggtggaagaaagtgctgaacaaaagcaggattctctcgccgaaaaacaggacatagttgcagttccttccgctttttctgatcttttccctggggatggtttgccgcgtcgtgcggttactcaattggttgaacagccacttgtggtggtggacttcctggctcatattactgcccagggtggacacgctgcggtgattgggtggaaggatttagcctacgccggggtgattgattccggaggtgtgtgcgagaacatcattgctattccaaatcctggtacggagccactgaatgtggcagcggtgctgtgtgaggggttggatgtggtcgtgtacaaaggcccggagatttccctgtcgccaaccagagcgaggccgttgctgggaaagctgaggcaggggactgctgccttggtgatggttggcacgaaagtaagctcaccggcgctgtcggtggatgcagagatcactgattatgttggcattggtgcaggtagtgggcgtattcgtggcgttgagatgcaggtgcgggctgtgtcgaaaactcacggtgtgcgcagcggaaaagtcctgatcagtaggcctcaggatgcagcattgcttgagcctgaacagccaacaacgttgcgggcggtcccatgacgcgggtgatggcattgtggtttccggattggcctgtgcaggcggttcatttggatgaagatgctcccgcgcacaataaacctgtggcgattgctgcgcattaccgcatccaggtgtgtggcgtggctgcgcgcaagcgtggggtgcgtcgtgggatgaaggttcggcaggcgcaggctgtgtgccctgagctggaggttgttgacgcggatgcagatcgtgatgcccggatgtttgagggcatcgtggcatcgctcggtgaggttgcctccagcgtcgaggtgcttcgtccgggtctggtcgcggtcgatgcgggagctgccgcgcgctattacggttcagaggacatcgctgctcagatgcttatcgacgccgccctgcgccaaggcatcgacgttttcgccggggttgcggatgagatcacgacggccgtcatcgcggcgagggcgaatggtgggactgtggtgaagagggaggcgtcgagaagctttttacagcagcaacccctgggcgtgctggcggccgaggaagcgctgggttgtgaggcggaggtggtgcgcgcgctggcggatctgggcatgcgcacgcttggtgagctggcggaactgccggtagaagccgtggcgacgcgtttcggcaacgctggtctgcggtgtcacaacattgcgcgtgccaggcacgatcgtaaggtcgcgccaccgatcacgcatgcagattgggaggtttcgcatgtgccggaggagcctattttgcgtgtcgacgccgcctcgtttgttgcgcgcaaccttgcctcgcgcctgcatcaactgctgagcaaaggtggcgtggtgtgccaattgctcaaggtcacagccgatttcagtactggtgatacggtgagcagaatttggcgtaccggtgaacctttaacggaacaggcaactgcggatcgggtgcgttggcagttggatgggtggttgactgcgcgcggtgtgcattccgatgatccgaatgagcacgatgggattacggcgttgtggcttattcctttggaatgtgtgccaccggatatggccagcggcggattgtgggataccgggcgcagccagcagcatgtggccagacaagtcattgagcgtgtgcaatcaagcttgggcgtggatgcggtgctgcagcctgttccggctggtggtcggggagtagaagaacgcattcattttgttccctatggtgaaaaacgtgatgctatccgcaatccagcggggtcgtggccagggaaaataccaggtccgctgcctgctcggttgggcggtgggatcaaccacccggcctcgcaagtgaccatgattgatacagaagggcagcgtatttacgtcaccgcagaggcattgctcagctcgtcgccgtatgccttgtcctgggggccggcccgctatttgatcactggctgggctgggccatggccggtggatgatcgatggtgggagaaaaacggcacaaaatatgcccgcctccaagtggtgggacgggcagtatctgaagaaaggcagctcagtgcgtggctgttgatgtggaaagacaacaagtggcggattgaggccacatattaggaaactactgcgctaaaacatccacaacgagacggtgcggatcctgcaactcagtgaccgagtagcggtgcttgccgttgaggccgatgacgaactgggagcgtccctcaaaagtacctgcgctgacgacctgggtgacaatgctgccggagccatccacggtgccgatctctggatcctcaaggcccaaatcgaaaggataaacagtaccgtcaatatttacgttcagcgctgtatcgcccgtgaagttgatggtgtttccgctgccctgctgggtgggattggaggtgtaatcaatgaaccaaccaggagttccggtgccagtgagatcaaataccacgcggtcaaagccactgtgagagccaatccgaacatcggtgaccatgagctgtgcaggcgcatcaggtcggagagtcttcattgctacatcggcttcgcccaatgcggttgggccggtggaagcttcgttggacaactgtgcgccatccgcagttgcggacatagtttgggttacagaagaagcatcgttggtggtggaattggaggttccacaacccgcaagagtcaacgcgctagcgccgacaatcgctagagtcttcaggcgggcacgatgctttgaatgagaagttggctgcacaatcatgcacacaccgtaaccctgggtcacccccgaaacctaagcaagacgcccaatttcgctcaatcgtgaacgaattgttgtaattcgtcttaaaaacgccaggagacgtgaaaattacagacaccccagacatcagatggaggcggcgatactagggtagaggacatgactcttcgctgttctgacgtcaatgttgaacccctgccgggaacggcaaaaacaggttctgggtttgttctccttgaacatgctggctcgtggagccgtgatgttttagacggcggaacatttgatcctgagttgactgatcaattgaagaggcacctgaaagcttccggaatgggtctgcaattaattaggaagccgggaagggagggtcgaaacgtcgaaaagcataatctttttctcgtttttgctgaggcctcaattattgagcacctggtggtggacgcgccggctgatgttttggatcttgatttaagcgggccgggcaaaaacaatgcgcagcgcatggatgatccgatgctgctgatttgtacgcattcgaagcgcgatgtgtgctgcgcgatcaaggggcgtccgctggcagctgccgtggagccacaatttgggccgctgcatgtgtgggaggcttcgcacaccaagggccaccgttttgcgccatcgatgctgctcatgccgtggaattactcttatggcctacttgatgaggccgaaaccgtgcagcttttccaaggcgcgttggacaacaaactcttcctgccgggcaaccgtggccgaggaaccttagatgctcgtggccaggttgcagaaattgccgtggcggaagctttcggcgaggcggttgctcctgcgagtttgcaggttgaattcgaagatgattctgttttggttactcatcccgatgggcgcacgtgggttgtggagcttgaacgcatcgaggtcgacggcgtggtgtcctcgtgtggtgatcagccgaaaactggaaaagcgtgggtggctaggcaagttacagaactgatcggataaaagcagagttatatctgatgaattgctattagcagtatcgttatcacagcaccaacaaagtagttcagccacaggaaaactttccaactgcgattagcctgttcacaactggcatctgtaatgttccaaaatcgtgcggcattaaatacgtaagttagaatcgcaatcccgatgatccacgccggattaggcaaagtagtgactaacacagcagctagtaaataaagtactactgaaagccgaatggctccacgcgccccaattacagtggcaattgagctcagattagcttcccggtctgcattaacatcctgtactgctccaaggatctgactggccatgccccacaagaaaaaggatcccagtgctatccacatcgctgctgaaggagatgttccagtgatcgttgcaccgattaatgcaggtgaagtgaagtgagtagaagatgttagagcatcgataaaggggcgttctttaaaacgcaatttcggtgctgaataagcaatcactgctagcactgagagtgtcagccataaagacgacatccaggtgccaaatatgaaaagaataactaggaaaggaattgttgagatagccgaggcccataacagtgtgctgtgggaacttttcggtagcacggccccctcgacgccgcctttgcggggattacgcatatcagattcgtaatcaaaaacatcgttgataccatacatggcgatgttatacgggataagaaaaaatacgatgcctagccaaaacagccagtcaatctctcctgcatttaataggtaggccagaccaaaggggtaggcggtattgatccagctaatggggcgagatgacaatagaattagtcttattttttccatcatgactacggcttttctggctcagattgcgtggtggtggatctagtagtgatgcttccattggcgatggtgggtaaggaatggtgtggacgttttttcctgcgtttaaacatatttccaggcaaccatagggcaggaatcagaagtactgcgaagagcggatagaaaagatcctctagggggattaaaccgagccaaatgccaaggtgctgggtatcgccatatccaaagagatcagcccaaaccatgaggttatcaaatatgatagttagggaacatagggtaagggcactgacagcggtgattggtaaaagtttaggtgttccagactgcagctttaagacaaataggaccatggctattgctaaaaaaggaatgcttataaaaatataagtcatggttcaacctcgggagtggtagttggttggaaagtatcgcgctgtggtgtgaggggagactttttaccgggttttttaggcagtggtgctttaagccataatgctgctgccgaggtaaggttgagggtgatgtagcagaggaagaataagaaaaaaagttcttcaatgggcatatggggtgcaaggttaataccggacataaacgctgagtctccgcgataaaaagtgccagtaataatgccaaatatatcccataaaagaaatccaatatatgcagcacctaccgaaagaattgctcgtaacggatggcggaagaacgctagcttccaacggtggtcgcacaaagccatgcacccaatgagaactaggagagtacctagataaataaaggccataaaaatatcgctatcttgctcattttgtgaaatatcgatgatagggatcaaaatttaatgatcgtatgaggtcttttgagatggtgtcgttttaggcggcaatggttcgggcagtggtcctgcactggtatcggcatgtaaacgcttaataatattctcggcagaaattaaacacatgggtattcctacacccgggacggtggtggcaccggaatagaagaggttattgaccttgcgggagctattgcgccctcttaagaaagcggactgtctgagggtatgtgctggacccagcgcactgcctacccatgaatggtagcggtgctcaaaatccgcagggccaatggtgcgtttgaccacaattcggtcagtgaggtcagggatgccggcttgcgtagcaatttgattgattgcatgtgacgcgattgtttccacggatgctgaagccgactgcatatacgcatcaccgtggccgatgctgctagaggccttggtcggaattaaaacaaaaaggttttcgtatccagcaggtgcaacgccgtcttcggacgttgaaggcttggagacataaatggaatttgatgcattgtgggggcgggtaagttgaggcccgtcgaaaactacagcaaaatcatctgtccaatcttcactgaagaaaaggttgtgatggtcgagctggggtaactctccttttacgcccaggaggattaataccgctccaattccaggattgcgattggaccaatatcgttcgggataggttcgaagttcccggggaagcagattattttctgtatggtgtaggtcgcctgctgaaaccacaagatccgcatctagattttgcacttttctgttgtgaagcaagctcacacctgtggcgcttgtgttgcccctcgatgaagcagtgttgatggaaatgacctcagaatcgagttgaaactcaaccccgttttccagcgctaactgatgcagagcgttaaccactgcagtaaaaccacctatagggtatttcactccctgcaccaaatcggtatgactcatcaagtggtacatcgatggggtagtagtgggtcgggaagacaggaagactgctggataggttaggatctggcgcaacaccgggctactgaattgactatttacgtacttttgtaaagaacgggtcagtagagaaaacagtcggccagctcgggtcagtacatcccggtgaagcagcgggcctaacgtggagaaattattataaaggaatctatcaatggcaatgtcataggcgtctgccgcgctatcaagataatttcctagttttgcacccgcgccgggttcgatggattcgaatagcgcaattgcttcttcacgcccagtggggacatcgacagcgtcatgtgtgccagaaaaaactcgataaccaggcgttaattctaccaaatcgagataatcagaagtacatgcaccaaaaagtgcgaagaaatggtcaaaggcctcgggcatgaggtaccaagaaggtccggtatcccatcgaaagccaggaaagcctgatatttcaagcgatccagctcggccaccgacatcagtatttttttccaaaacagttacttgccagccatcacgtgctaaaagtgcagaagtggctaaaccagcaacacctgcgcctatgactacggcggtacctgaggagcgtggagttttagtcgagaccttcatcacgaattctttctgtagatgctcatagatagacctttcatcgtggctctagcgagtgtagagagtttgatatgaagtggaactctgattcgctcccgcaataaatcggcggtaggagtagcctcaattcggtcagtgagtttttgaaagagcaaataagcagagatcactccgatgcgagcctgcactggtatttctggaaatgcatcgtgggcaattgctaggtcttgacggatatcagcgatgagatcttctttttgttctttagtaagagttccttggctggttttggggaaataaaatcggcccaaattttgctgatcttctgccaagtcacggagaaagttaattttctggaatgccgctcccaatgagcgggctccgttttgcataatctctagccgttttttgctaatcgttctaccttggttgaaaacgctgagacaaagcaggcctataacttccgcggagccatagacatacgttgtgaagctatctgggtcgtgtgtattagctttgaggtccttacgcattgatgcaaagaaggctattacatgctcttgttcgaaatcacagcgtcgggcagtttcaccataagcttgtaaaacaagatctgtgttgaagcgttgttgtggtgctgcaagaaccgcaatttcataggcatcgagaatctcttcgattttggcagttgagcaaccagcggcatgtgcagtgccgtcgacaatctcatcggcgatacgaactactgcatagagatttcgtatgtcatttcgtatgcgtggggatagcaaccacgtagacagactgaagctcgtcgaatattcttcgatcactttatgtgaagccttgaatgaggcccgattgtaaagtctcagtgcacttttaaggaagagaggcgaattttggtgtgtcatagctgaggctgcttctggtatttctgattggacaattttgacggccaccagattttcggtccgatgtcgtagaacaaagcaggcaccaagaaggcgcgaacgagcagggtatcaataagaactccaaaagcgacaatgaaggcaatttgtgccaggaatagaattgggatgacatagagtgctgcgaacgttgcggcgagaactactccagctgaggtaattactccgccggttactgtcaggcctcgaagaattccaagtcttgtgccgtgggttttggtttcttcacggattcgggtgactaagaaaatgttgtagtcgatgcccaaggctactaaaaatacaaatccgtagagaggtactgcggggtctgctcctgggaaactgaaaacgtgattgaaaagtaaagcagccacgcctaaagcagtagcaaaagacaccacggtggtgactactagcaggagtggtgcgacaatagaccgcagcaacagcatgagaataaccaaaatgaccagcaatacaattgggatgatcaggttgcggtcatggatggaggcatcgttagtgtctacggaagttgcagtgacaccgcctactaccgctgatatattttcatctgcaaaagtttggcggatactgcgaatagctttttgagcttcttcggaatctggtgcttcgacaagtgttgcttgtaaaaggacttgcccttctacaactaccgggcctggagctgtaccagaacctaacggcacaataccgtcagcggtgattggggctgagccagagggggagtcagcactagttacagttacagtctcgaaattgtcgttgttaaggactacgtcagcagcctgtgctgcctgtgtttcatcaacgataatataagcaggactgccggatccaccggggaagtgttcgcctaaagcctgctggccatcacgtgcttcagaggaacccagaactaggtcggattgggacacaccgtccgcttttagtgtgggaacgaaagccgcacccaagagaagcacaataagtgtagatacccagattgcacgaggatgctgctccactaaatcagccacttttgaccagatcccgctggcggggatgtcgtttttcgcacgggctttttcaggttcgtattttggtcgcttgggccaaaaggccacccgaccgaatacaaacagcagggctggtagcagagtaagagcagaaagcattgcaaaaataatgcccaccgaagctactggacctagcgtggagttagatttcaaatcactaaatagcaaacaaaggaggcccgcaataacagtgctgcccgaggcaagaatgggttccaccgatgcccggatggctttccctgtggctatccctttatcttgttgaacgcgtaactcttcacggaaacgagcaacgtatagcaatgagtagtcggtggcggcgccaatgaccagaatgaagaggatgccttgagtctgacccgaaagcagcaggatgtcccacttagctagccaccacaccaccaatagagctacagtcagcgcaaacaaactggtggcaagcacggcgatgggcagaatgaaggagcgatagacgatgacaagaatgacaaggacggcagccaaggcgactgctaggagtagcccatcaatacccgcgaaagctgcgctgagatcagcggtaaacccagccggtccggtcacataggtgctcacatagtccggcgtttgctgggtcaaggtctcagagagcttctcgacgctttccgtcagctccgctgatggattgagggggacaaacacttggacagctctgccgtcctcggatggaatagcaggggagacttcatcggaaactatgtctaattctgaaagcccagcaacaacttcattgagttgtgtgatgtcttgctgtgttaagggttcatcgctgaccattacgacaatggctgggatggattcagaatcagtaaaatctcccaactgttcctgtacttgagtggcatcggcagattctggcagatatgtggtctggctgttggaggagacctcactaaccttgccaaaataaggaccgccgactccagctcctacaagccaaactaaaattagcaaggcgggcagaaagattctcatcaagcgaggaggaccagatttcttcttgttctctgttgtgatgctagtagacatcaaattcacttccgttaaaggcgtaaaggttagttctaagatttgcggctggctagttgctcaacttgtttaagtaataaattttgagccttgggatctacctgggggcttagtgttttgatcatcgaacggcagatatttaagtggtcggagatggcattcaaggagtgattctttgctccacactgtatgagaagatgttgaattcgctctgcctgagaggtgctcagatctgcggagccgaagttgtcttgaatatcagtccatttagcagtatctcgagcgaaggcgataattgtagtttcttttccttctcgaaggtcagaaaaggcatctttgccgtgttcggctgcgtcaccaaaagtagataagtaatcgtcctgcaattgataagcgatgcccaagtttgtgcctatctcacctatctttgtttcaatctcctgaggtagttccgcgagaattgccgctgctctcattggaagttcaaaagtgtatgtggctgtttttagccgactcatttctagagcaatgtccatattggggctgatggctttgctgcttaatcccacatcaagaaactcacccacaatagtgtcatttatcgtgtggttgagtaaatctaaaagtcgaacccgttggtgatgtggaaggtcaaggcgcgcgaagatttgatgggtggcagcaagaaaaagatttcccataagcagtccattagattgtgcccaatctagatgctctggatcgcgctggatttgtgcaaaactttcaggtgtgcgatgcatgagaatctgcccaataaaattaagtttgcctcggcgatagaggtctccgtcaataacatcgtcatgaaccaaaagggaaaaatgcagtagttctaaagccactgctacctgtaaaacggtgttgagtttgacctcaatgtcatcgtctacaagcgtgttgtatagccccagtagcattcgagggcggattaacttgccacctcgcaaagcttggaaagcagcatctaggcaggtacggaactctggttgatatgtgctgcactgttgagatagcgaagcgcagatgcggtttagttcccgataaatctcatcattgaaatcaagatcaggatgagttgaatgttctgtggtgattgtcatgccattgtccattcgagtatcacacggccagttatctcgcaaaaattcccaatcgttgtatatggcgctttattttgatgaagtacagaaagtgtgaatttgggtccataaaaataatgtgcctacaagaaatttatagtatcccatgagttaatatttttaaaaataaactttatctgactttgtagaaaaaggtgattactatgctgaatatgcaggaaccagataaaatccatccggcagaacctacacttcgtaatatttatgacgttaaaactagtgatcccaaaagtgaattagttgatcgttctggcatgtcggaagaagacattgcgcaaattgggcggctaatgaaatcgttggccagtcttcgcgatgtggaacgtagtattggtgaagcctcggcacgttatatggagctaagtgcccctgatatgcgagctttgcactatttgattgtggcgggcaatgcgggcgaagtggtgactccaggaatgcttggagctcaccttaagctttccccggcatctgtaacaaagacgcttaataggctagaaaaaggtgggcatattgttcgtaatgtgcaccccgtcgaccgcagggctttcgccctcatggtcactgatgccactcgtggagaggcgatgcggacgcttggtaagcatcaggcgcgtcgttttgatgctgctaaacgattaactccacaagagcgtgaagtggttatccgattccttcaggatatggcacaggagttatcccttaataatgcaccatggctcaacacggagtagatgaccatctacgttaattaaagtgtgcagagcggagtggcggtgtttaagccacctgtcgctgggactgtaatgaatgcgcatggccaccacccactgtcctctgtaatgttccgaacgtgagaccattggtcactactgagctgtggcgtgcgggatagtataaatcctgaggaccggcttgggctgccgacgattgctagtgaataatcatcttcgatataggtcacgcggtagtttgcttgattgtcttcactctgaaatggaatacctgggaagctaacctttaatgaagcattggaaactactttagcgctgccttcaataactgaaggcccaaagaaagtgccacacttatttgttacagagattgtgtccgagtcgatcacgccgtaatcagcggtaacgtcatgtgagcactgtaaagagaatggttggggaattgctgcgacttgataccacttgcctttgtagcgttctaggtcaatgctattttcaatttcgggcagcgctaggttttcaggaaccgaacttaggttagatacctgcgaggagccacctgcaagtcgtccgccgtcaaaaatgtcttgggcttgtgccgtggatatcccgaaaagtgaaatggctgcgagtagtgctgtggtgacaagtttgcttgaaatgcgcataaagcaaatcctttcttcatgtttatattaactcaatagttattacttctaaaagtatagtagatagttgtggatgggtgaagaatttcatagaaatcgcactcgattcactaaagacccaagagtaaaatcccaggatttgcttatacttgcgctcatggataatcaacttcgtcccactttgcattatcaagctcaaaacccgcaccggcgagtgctggtcaccggtgcgacaggctacattggcggcaggttgattactgagttacttgctgccggtttccaagttcgggccacctcgaggaaaaaaacaagtcttcagcgctttgactggtacgaggacgtcgaggcagtggaagcggatctgactgacgcgactgagttagatacgttatttaaggatgtagacgttgtttactatctagtgcattccatgggaggtaagaatgttgattttgaagagcaagagcaacgcactgctgaaaatgtaattcaagctgctgatcaagccgggataaaacagattgtctacctttccggcttacacccgcgtaatcgaaaaatagaagaactatctaagcacatgcgctcacgggaaaaggtcgcccagattttgctggcaggccagacaccagctttaattttaagggctgccacaattattggttccggctctgcatcatttgaaataatccgtcatctcacggagcgtttgcctagaatgatagcgcctcagtggattactaatcagattgagcctttagcaatacgggatgttttgcattacctaatctcggcggctgatttaaaggatccagtcaaccgctcctgcgatattgggtgtggaaagtcgtatgaatttgcggatctattgcgtatctatgccgatgttcggggactgaaacgtcatgtaaattccgtacctctcaatttgcccatggacaagctatccggtctttggattagtctagtgacacctgttccatttcaattgtctttccctttagctcaatcaatggctgaggatgccgtcactgaagagcacagcattaaagatattatttcagatccacccgatggttttattgagtatcgggaagcagtggagctggcattagctgcagaatttgatcgtggagttccaacgtcatgggatcgaagctggactgtacaacaaccgtgggctggccagcctaccgatccagagtgggcgggcaaagctgtatatgaagacgtccgcacagaagatactgatctccgagcagcgcaggtctggccgatcattgaaggtttgggtggcgtgaacggctggtattctgcaccactgctatggcgattgcggggtatcgctgacagactcatcggcggtccaggtttgggcggacggcgggatccccgtcatttgaaacttggggatcgcattgattggtggcgggttactgagatcgatccaccacatagattagtgctcaccgcagagatgaaagtagatggtggcgcttggctgatcctggaagttgcggacaaggaaaatggcggatgtacttatacccagcgcgcaatatttgagccgaagggtttgcccggttatctctattggtgggttgtttcaccgttccatgcgattatttttccttatatgcgttcgaatattttaaaagctgcgcgtaaactcacttaatcgcagagtaggcgtctaaagcaatttgacgggattctttcagatcgacgatgggatccggatatgatggtgttccatattcgggtacccagcgacgaatataagtttcatctggatcaaattttttcgcttgggtgaccggattaaaaatacggaaataaggcgaagcgtcatctccgctacccgcagcccattgccagttgaaagcattagaagctggatcagcatctacgagagtttcccaaaaccattcttcgccatgacgccaatggatctggagattcttggttaaaaaactagctactaccattctgacgcgattgtgcattgacccggtggcccataattctcgcatgcctgcatcgaccagcggaattcctgtttttcctgcacgccatgctgctaaatcctcatggaattggtcagctttggtggggataagaggggtggatggagtgttaagtttatctttttcactcggatcccaggaccatccgaaacgattaaattgcatacgaacgttttgcgtgtccatgtgtggcagggcataaagtcgatgccacgcaaaatctctccagagaagttctttaagaaataactcagttccttcagagtctattgctgcagtctctgcccacacgcggtggatgctgatctcaccaaaccttagatgagcagataatttacttgtagcggatcgggctaagctgtctcgagcttgcgggtagtcctgtagatgttccaaaaaatcaaagagtttttccgaagcatttttttcaccgggagcacactccttaactaacgttgttgaccaaaaaggttgctccatttctaggatgggcagctctacatcctctggtcctgttaggtgagaggggacaggcacattgtttttaacagtttcatatgcatgtactctggctacttcccatgcggctttagaaaaaggggtaaataccttgtagggagttccggtagcggtactgacttcccagggttcagtgagtaaaaaacctgggtggctatgcacttcaatccctttatcacggagattctttttgagagtggcatccacttcacataacggttgatgatagcgtcgattccatgtgacggctttgacttccatctcagagactattttcggcagtatttcaagcggattaccggtacgtcgtagtaaaggtactccgtaaaaagaaagatcttgggctaaagcattaaggctttgttctcgccaccatcgtgctgcggccccaatgctgcgattgatcgtttcatcaatgaagagtccaataacggggccatgatcagcagcccattttaaggcagcattatcacttagtcggaggtcatcgcggaaccatagaagggtgggagagcgttgtggatcattcatagctaatgagtttaaaataaacacccttgcgtttgcattcattcaaccgtggagaaagccagatttatgacaacctcaatccaacgcagaatcagtatcgtaattccatgtctaaatgatgcagtacttctagaacagtgcttaagctcaattgttgcgcagactcttcaacctgaggaagtcatcgtcgtggacaacggtagcactgataactcagttgaagtggcaaatcggatgggggctcgcgtggttcatgagccacttcaaggcatcacttgggctagtgcagctggatataattctgcgcgtggagacctaattgtccgtttcgacgcagattgtgtgattcctcctgatcatctaagccaagtcaatgccatttggaaccgtacagaggagacgcctggccgtactatagttgcgctaacaggtaccggcagttttgatattcctggccgtatgggagagtggttggctctatgctatctaggcgcctaccgatggtctacgaaacaagcactaggacactatccgatttttggttcgaactccgtaattagcaggcaatggtgggaggatgtaaaagaccaaattacgttatcagaaacttttgtgcatgaggatatgtacttttccttctttgtccgcccacatgagacggtctggttcgaaaaaaatttaaaactcatcatgcatccacgtgctttgatgggagtcaggcagtcctttatccgattggtacgaggattttatactattaaaattgcttggaaaagagaaccagtccatcagcggctggaatctagaagagattggacctaacttttcttttttagattcctaacatctccgagaacctggggttgggggctcatctgtttatggtggttaatcacaacacatcttaggagattaatcgcgtctgaatcgaccagaaagcgctgtagcttgaatcctagcctatacaagaagattcggctgcaagaagattcggcatagaattttagcggcttatcaagcctggtgcctatgattattaaggctgtattagtcgtaatcggaatttatgaggtcgttgtccaacccgaacggatgctgtttattttccttattcatcttggctttcgattctgcttaggcggtttgtgaaatgttgtcaactggttctggttcgaaagaacccaggtaaatagtcgatttttggattttataatcaaaccacccgacgtcgtttgttcgccagcacgatgagcgcgcacagtacagatcctgcgaccatcgcgagaaccgttccgccgagaatgtctacttgaagtggtgccgtcgcagcggtgttggtggcagaactggcaacgaatctgcctaagaatcctcccgaaactgcaccaacaatggcagccggcaatgagagcgcgatcatttcaatagccatcaccagaatctgaccagttgaggtcagtccaatggtgcgcagcaaataacgatcgcgggcacgctcagaaatggtgagtgccactgtgttgatcaggccaacggcagcgatcgctaaggccacgatggcaagcagtgtggacatggtggtgatgcgggaaaccagttcaaaagtgttttggcgggcggagaaaccctcggtgatggagtatcgtccgtcgaaaagcgaaatggtcttgcgtaccgcctgcgccgtggcgttgtcgggggcctggttggagtcgccgtcgagcaggatcagtacgttgcgtgtggtgctggggccggtggcgagtgctgggtcgatcatggagaagtagttgtcgctgtggaagatttccgcctgcgttggggtatccgcgacaatgatgtttgcagcctggccggccgggtaagcatcctggtcaggagagtttctgcccaaaacaaggccaccagctggtgcaccagtatcgcctgcgcgcatcacggaggctccgtcttcttcagcgagcatgagcacagagaaattgccggaatcttccaattccacagcggtggtggctggcgcgatggcagttttcacgccgtcgatgctagagatttcctccagcattccggcggggatttccccatcaagcgctgtaaccatcatgtctgtgccgcccatgcctttagccacggccaccaaatgcgtgccgatatgtgcctggccatgcagaacagcggagcttaatgcagaaccagcaagaatcacagcgatcagcgccgccgaacgagatttctgctttgctgcaaacgccaatcccaactgaagtgttgggacggtgccgcccacaatcctggagaatacgtgcaataaccagggcacgagcaccgccgtggcaatcaacaacgcacacaccaaagcgcctgaaccggcgatggataaagccactgaacgcatgccgcggtagtccgaggttgcctcatacgcccacattccgccggcgcccacaatgcccgcgagcagcaaccataatgcaccgaaccagggggaagtcctcgaaatagcaggcgtactcagtgattccactgcggattttctgcacacactgaacactgccggtaatgccgcaatcacggacatcaccacgccgacgccagcgatgagccacatcgtgctacttggcagatcaatcacatcaatgggcacacgaatgccaaaacgtgcggcattatccgccaacaaacgcgccgccatcaatccggcgggcgcaccaaaaccagcagccaccacaccgaggatgccggcttcaaaaatcactgaccccaaaatctgcggcgtcgatgcgcccactgaacgaatcagcccgaactcgcgaactcgctcaccagtgagcaccgaatatgcagaaaagaccaccaaaaacgccacggcagcagccactgccacaaacgctgcgagcagcaagaaatagcgatctcgctggcccaaataagaatcagcaagcttatcgacgtgcccctccgccgaagcaaccaccaccgtagcgtcgctaaagcttgcagcctctagcgaggcaggatcggaagttgccactcggaattcaccccgcacaccggaagaattccactccatcagcgcatcaggagacgccacaacgaacggtgcgccacctaaagtttcctgcgccgctggctccaccacgccaaccacaagaacctcagtgtcctcagtgttttgggacaggcgaatggatacgtgctcaccaacttcaggcgcacccggggccgttgttactgcaatctcaccaggtccttggggcaatcggccttctaggattggccgccactgcagtgggccttccgaaattgactggactgaagtactggcgtaaatcccgtctgattgctttacagaggctgcaaaattttgatcaaaagccagagcttcaacaccaggtgtcgtagctaattgttgctcaaaagctgcaaaggaatcttcgtttttcgcagacaccgtgaccacaagatcagcgttttcatacggcttggcaaaaagatcattaacactggacaccaaagaatttgtcaacgcagtggcgctaacagtcaatgcaaccgaagcgaaaatcgcgaaaaacaatgaaaaatagcgcccacctcgtcgccgaagttgagcgaaagcaagcctgaacattaacgccccacccgcaaatctgccgtatcgatgatcttgccatcacgcattgtgatcaacacgtcaccacggtgagcagcatctttatcgtgggtgacaaacacaagtgactgcccaaaatcatcaacaatgctgcggaacaaattcaacactgcatcgctggtgacggaatccaaacttcctgttggctcatccgcaatgacaatatcgggcctagacatcaacgcccgggcaatcgcggcgcgttgttgctgaccgccagacagctccccaggcaaatggcgcatacgattatcaatcttcaacacactggtgatgtgttcaaaccactgcttatccaccctgcgatgcgcaagacgcaacggcagcaaaatattgtccttcaccgacaaaataggcaccaagttgaaatcctgaaacaccatgctgatgtgcgtgcgacgcagcttggcacgcttattttctgacagggagctcaacgtgatgttgtttttgttcagtgtcactctgcctgaggttggctgcgccaatccggaaaggcactgcaacagagttgttttgccagagcctgattgccccatgatggaggtccatttgtcggactgaatctgtacagaaatgccatcgagagcccgaacttctgttgatccttttccatagatcatcatgagatcttgggctgaaaggaccggcggagcgttatctgtggcagggttcaagattattcctttggggcgtagctgcgtgggtggactaacgcatcaacactatatgggcatttgggcatagaaaaacccgcgatgcctacttcgaggtagatatcacgggtttttctatgcaagaggtttagcggcgcatgatcttcttggacagccaattgcccagaagctgggctgcctgcacgatgatgacgataaccaggacggcaacgtacataacttcgttgtcgaaggcgcggtagccgtaaacaatggcgaagtcaccaagaccaccgccaccgatgtagccgaccattgcggacatatcgacgatcgcgatgaacaggaaggtgtaacccagaaccaatggtccaagtgcttctggaatgatcacggtggcgatgatgcgcatcggggacgcacccatggagcgagctgcctcgatgacaccaggatcaatggagaccaagttttgctccacgattcgagccacagagaaaatcgctgcgacaaccatgacgaagatgccggcatctcggccgatggaggtgcccatgacggcgaccgttagtggcttgatggcggcgatcaaaataatgaatgggatgggtcgaacaaagttcaccagcacattcaaaatggtgtagatgaccttgttcttcaagattccaccagcgcgggtggtgtaaagcagcaggccgacgacaagacccagtaagccagccaccaccatggtgatgatgaccatcaacagggtgtcaatgatggctgtttggaaggtgggtcctagccggttccagtcagctgcgaggatcatctcgttcatcgggtgatctccttgatggtcgtggtcttggtcaaggtttgatagaactcttcaatcgcagcggtgttgccggtgagtcgaacagtcattttgccaaatgattggcgttgcaaggtggtcacgccaccgtgaacgatgttgacaaaagcaccttgttcggcagcacgagcggttgctgcaaagaagccggacgtttcagtcagatcaatggtgaacagacgtccctcatggctaagcagatcttccgattccacttggtctggggtgttacgcagcgcggtggccacgaacttttgagcaacctgtgtttgtggattggagaacacctcgtagacgctgccgtattccacaactttgccggattccatcacagcaaccttgtctgcgatggaacgcacaacttccatttcgtgggtgatcacaacgatggtgatgcccagttcgcggtttaccttgcgcagcagctccagaacttcatgggtggtttctgggtccaaagcggaggtggcttcgtcggcaagcaaaagcgttggattggtggccagtgcacgggcaatgccgacgcgctgcttctggccgcccgacagctgctcggggtagtttttgcctttgtcgcccaggccgacgaactcgagcatttcttgcacgcgagctttacgagctgccttgtccatcttggcaacttccagcgggtactccacatttccagccgcagtacgcgactggaacaggttgaactgctggaaaatcatgccgatattactgcgcagtttacgcagcttagactcgggcattccgacgatgtcggtgccgttgagcagcaacgaaccgctcgtgggggagtcaaggccattgatgaggcggacaagagtggacttgccggcgccagagtaaccgatgatgccgattacctcaccgggttctacggtgagagtgacattatcaagcgcggtggttttagcagatttattgttgctaaagactttggttatgccgcggaactcaacgcgagtgccctgggtgctgggttgctgcgcggagtattcctctggcgtcggtgtggacgcggtgtgtgacacgacggtgtcctcgattcgtacaaaagtcgggggacaaaagctggaagacaaatagtttaacgccccgaggaagcgtacgcgacgtggtgttcgtcaaaagattccaagcggggcgtttgaagttcacagtctgattttcaggctgtgattgtgcaaagaaatctgcacatgggtatgcaaagaactcaaaagagattatgcgttttcctgatcagcctcaaggcgatcaaggatttcctgaaggtcagctcctggacgatcaactgggacggaggtgccctcagagtcgcggtctactgcagccagaacctctgggtcgtgccacagctcaacgaggcgggcgatgttggcatcgtccttgtcctcagccttggtgacgaagacgttgatgtatggctctgcttcttcagactcaggatcatcttcgaagaccgcgaggtttggatcgatgcctgcgcggtcaaggaaggagttgttgatgatcgctgggcgaccctcctggtaagcggttggtgcctgagctgcgtcgactgggatgacggaaaccttggaagctgcctcgtcgatatcgactggagctggggtgaccagacctggggtcttcagggtgaccagacctgcctgaacgagaacgttgatggcgcggccctggttggaaggatcgttagggatggcaacggactcgccgtcaatgccgtcgatggagtcgtggtccttccagaatagtgccagtggcacgatttcgctggagccaactggggtgaggtctgcgccggagccgacgttgtactcagccaggaacttcaggtgctggaagaggttaacgtccagctgatcctgggcaagagcctcatttggggtggagtagtcagagaaaggaacgatgtcgagggtgatgccctcttcagctgccttgtcttcgaatacggtccatgcttccttcgcagcgtcggtggtgccgatgcggatggtcacgccttcggtgccttcagcaacagtggtgctgcttccatcggaatcggagccacaggcaacaagtgcggttgcggcgaagaggccagcgatggcggtggttgtgatgcgacgaagtttcattttcaaatacgtccttgtttgggaaagtttttgtgaatggatcatgaaatggtcattcaagtatttaggagattagcaccatagaccgcgatctgtacagcttggtctatttccttctccggctggcgtggaaaacttattggaaaatttgttctaaaaatgtatcctatcattatggaatggaatggcgggggaagctttaacggcaggccattatcgtggtccaaattggaaagaatcctctcaggtaaaaaggtcgaatctctgcgtccggtgctgcatgagccggatgcgcaggcgccttcatctgccatgcagggggaagcgtcggttccttttgccgagctgcatgccaccagcagttataactttctcactggcgcatcggatccgtctgatgtggttgtgcaggccaaaaagttaggacttgttgctctatcagtcatggatagggatggtttttatggtgcagtgagatttgcggaagctgccgcggaagctggaatgcataccgtttatggtgcggagctgagtctgcaagaaggcgtgttgacagtcttgtgtaaaaatccggaaggctacaaaaagctcagtcacctgatcagtgacgcgaaaatggcaacgggagaaaagggggaagttcgctatccgccgctgccaatggttgctgaacatgctgcaggggattgggtggtccttgcaggttttcagtggttggacaaaatcgactatgtgatcgattgctttaaaccggaaaatattgtgctggaattcggttcaaccatgacaccggaagacgccgaccgcaatgaatacctcagaagaacgcaagccaaattccagcttcgaggcatcctaagcaccaacccagaatccgctgcccgggggagcgtgcggcttgccggcgccaagcaggcactagcccgcaagatgccgcttgccgacgccgaaagcgagctacatcccatgggcactacctggatgcgcagcggggatacattgttaaaagcacaccctgattacgcggatctcattgcaaccacggtggaattagctgctgaatgtgctttcaccctagatttggtggccccgaatctgcccaagtgggatacccctggtgaacacacggaaatgtcctggcttgcgcacctggtttccactcggattgatacccgctatgtggggcgctccgcagacatcaaagcacgagctgccacacaaattgactatgaattaggcgttattgaaaagctgggttttccaggctatttcctcgtcgttaatgatctggtggagttttgtcgcgattccaatattttgtgccaaggcagaggttccgcggcgaactcggcggtgtgctttgtcctaggcatcaccaacgcggagccgatctctgctggattgttgtttgaacggtttttatctcctgaccgggatggtccaccagatattgacattgatattgaatccggcaggcgcgaagaagtaatccaatacgtgtatgaaaaatacggaagggataacgcagctcaagtagccaatgtcattacctaccgaacaaaaggcgcgatgcgtgatgctgcccgtgcactgggttacccgcaaggtgctgccgatgcctgggctaaaggaacctcggaaccacccgatgatgtgctggaattagctgcgcaatttaaagggcaaccacggcatttgggtattcactccggtggcatggtcatttgcgatcgccccatcgccgatgtggtgccagtggaatgggctcggatggataaccgctcggttgtgcaatgggataaagatgactgtgccacggcaggcttggtcaaattcgaccttttgggattgggcatgttggaagccatccatcacatgctggatctggtggcagaacaccgaggtaaaaagatcaatttgtgggaactagatctggcggaaccggaggtctatgacatgttgtgcaaggcagatgccgtgggtgtgttccaggtggaatcacgtgcgcagttatccacgctgcctcgactcaagccccgcaccttctttgacctggtcgtggaggtagctctgattcgtccaggtcccatccaaggcggatcggtgcacccgtatttgcggcgccgtgctggtgaagaggccatcacttatgaccaccccgtgttggaaaagtctttgggtaaaaccttaggaatcccactgtttcaggaacagctcatgcaggtagctgttgatgctgcaggttttagtggtggggaagcggattccttgcgcagagcgatggggtcgaaacgctcacctgaacgcatggctgcgttgcgctcgcggtttttccaagggctgaaagataccaatgggattgtgggggagaccgccgagaaactgtggaacaaaattgtggcctttgctgcctacggttttccggaatcgcattcgcagtcgtttgcgtccttggtgtatttctccgcgtggtttaaataccactacccggctgaattctgcgtgggattattgcgggcacaacccatgggtttctattcaccacagtctttgatcagtgatgccagacgccacggcgtgagtatcctgccgatcacggtcaatgattccggtgtggaggccgatgctccgaatggtgcgattcgattggggctcaacctggtgaaaggccttggccacgatgccgcgcaaagaatagaggacaacgccccgtttgattccattccggatttatcgcgccgggctgatcttaatgttgctcaagttgaggcattggcgcgagcgggagcggtggactgcttgggggtcggacgtcgacaagcattatggcaagcgggcgtcgcagcgaccgaaaaacctggaatgctgcctggcctttcggtgattgaagctccggcgttgccggggatgagcgcctttgagctgatggcgaccaatatttccgccacgggagtcaccgcggattatcagccgatggcgttgattcgggagcggatggaggagctggggatcgtgccggcggatcggctattggaggtggaagatggcacgcggctgcggatcgctggcattgtcacgcaccggcagcgcccgcaaactgcgtcggggctgacatttttagggatggaggatgagaccgggctgatgaatgtgatggtgtccgttgggttgtggcagcggcagcgcgtgctggccagaaatgccaaggcgttgattattcgagggattgtgcagaatgcgcaaggggtggcgacagttgtcgctgaccggttggaaccgttggacatgggggagtttctcagccgtggctcacgagattttcgataatttggcaaagtggacattatgacaaatacgcacaggcgaaccccagaaccacatgagggcatgaatccagtgtcaccaaaactgaccacggccaggtacctcacccgcattccatggctgctgatcagcgcgattgtgtttggggtgcttggagtttttgtgtcttcgtggttttacgccggtgtgatcgtagttgccgtcattcttatctggcagctgtggctgatcccgcagcaggtcaagcgactgggatggctggaaacctccgatgagctgctgatcaccaagggaaaactgtggcacaccttcacggttgttccctatggccgcatccagtttgttgatgtcaccgcaggtcccctcgagcgcgcgtttggcatgaaacaagtgcaattgcataccgcgtcggcgtcctctgactccaccattcaaggcctgcctgtcgcggaagccgatgccttacgtgagcgactggctattaaggcccgggagaggatgagcggactatgagcagccttgaagggtttcgaaaagtccaccgcgccaccccattccttcgcatctggaccatcatcgtcgcagttctcgcggcattcgcattcaattccggcgcatccgttttaagtttcatctggggtgtcgtcaccggcgaatacggattcgcagtgctgccgattctattgaccgtcggtggcgccgtcattgtggtggcactggcctggattatcaccggaatttggtggaaagccgtcggattccgcatcaccaatgaagaggtgcagctgcaacgcggagtgatcagcaaagacctccgcaccgcccgatttgaccgtatccaagccgttgacctggtggaatcattcatcgcccgtatcttccgactggcagaagtccgcatcgaaaccgccggcggcagcgactccgccatcagcattggctttttaagaaaaagcgaggccgaggccctaaaaagggagcttctcgacgcctcccagcactcagtcgccaccaccccagccggagttccggctgagcctggggtaggggagaccgttgtagttgagagcgcgggcgatgttctggttccacaaatccccgtgcaacgcaccctcgccagcaccgccttatcactagcaaccatcatcaccgcgatcggtattgtgattttgctcttcgttcctttcggagtgagcattgccgtgccgttctttgtaggcatggtgccagcggtctggaacttgatcgataagtcgtggcaattcaccgcaacacagcgcaacgatgtcctgcatgtcagctatggacttgccaaccgccgcaaacaatcaatcccactgggacgcatccacgcagtgaaactaaaacagccattgctgtggcgactggttggctggtggaccgtgaccgtgactgtagttggctacggcgacaccacccaaggcggaacctccaaaatcttgcccgtgggttccaaagaactcgcactaaaagtccttgaagcggtggggccactaaacagcgccgacatcgccgaatctgcagacccatcacatatgagcagaccccagtacacaccaccagttgctgcacgcctgctcacaccagtcgatcggacccgccaaggcgtcacgttgattggtgtggctggtgcccctggtgcggtggtcgtgcatgaaggcagattcatgccacgtatgtctgtgattgatacctcccacatccaagaactcacccttaaacacgggccgatccaaagaatactgggactctccaccgttgtgtttaacctggtccaagggccagtgggaatggccgcatcggatctcagtgcagctgatggaaaagaacttctcaacattctccgcaacagaaaactacccgcactggaatcagctccgctgggacaaaacagcctggactaaggtgtaatcatgcacatctcagatcttcccgataggtcccaggactacctgaagacaatctgggacatcacagaactccttgatgatcaaccagcagcactcggcgatatcgccgaaaaaatgaaccagaaaactcctaccgcctccgaagcaatcaaaaagctggcggcaaggggcctggtcaaccatgaaaaatatgctggtgtcaccctcactgaacagggcaaaacgctagccatcgacatggtgcgacgccaccgcctgctggaaaccttcctccacgatgttttgggatacacctgggacgaagtccacgccgatgcagacctgttggaacatgcagcctctgatcagctcatcgaacgcatcgatgctcacttgggtcgtccacgcaaagatccccacggcgatcccataccaactgccgaaggcgttattgaagagtctccccgaaccaccctcgaggcagttcagccaggggagactgtcacgatttccagggtcaaagacattgatcctgaattgctgcgctacctcgcgcaatacaacgtctcaccaggatgccggatcaccgttgcgtccggcccactagctggcatggtgcatgtcgttgtagaaggcaccgacaccagcttccccctggccgaaacgcaactgccattaattacagtgcaggactaagcagattcatcataatggtgctcatatttcccgatgagaccaaaccaatctgaatgatgaccgccaccgagaatacgaacagtaagaacttatcggcaggaccgttggcacgaatgcttaaaaacttaggcaatttgaggttccaccagcgtttgcccttcagcggaatgaccggggcaaatgctgggataccggccttagtggccatatcgccagccaagtgggtcaggcttccaactgtaatggcggagcctaacacaatgccgaatgaactttcgggagcataattccatactcccactgctaatgcagcggaagctccagtaactaaaagccaatctgcgttctttgaccattcaggcatgagacctctaatggcgagcccgaggaagaaaaacagcaaaccaatcaccgcaggttttccataggcgccaattagcgctgtggcaccagcgcctgtggcagcagcgctccacaccgtatgtgtcaacgtgcggtgcccgttgttgcagtgtttgtctttcctgcccctggtgacattgacgaaagtttggcaaatattctctgtaaaacgcgaaatcacttgggtaatcggaccaaaagaacgcgacaccgtggcctgcggtgaatcaaggtccgggagcagcgctgcacccgccgctaaacccgcataaataaaagcctccgtggcggtggtaaccccaccccattctgctgggagaatttgagcaacagcaagccccacggctgcaccgctcatagcgtgggttggccccataaccacttgtgcatcaactactttcacaactaaaaattcaaaacttaagtgagttcaagaataaaccaaagggtggacacttattcgaacgggtgcttgatttaggcaacttgagcaaaattctgccatttcgcctcaaatcgggctagttttgaagcatgagcgaacgtcagctggaaaagtcaattgagcacgccgtcgagttagcccgcgaagcccgaaacatcgaagtttttaccggagccggaatgagcgccgactccgggttggaaacgtatcgtgatgataaaaccgggctgtggagcaacgtagatccacaagcgatggcaagtatcgatgcatggcgcaaagatccagagccaatgtgggcgtggtatcgctggcgcgccggggtggcagctagggcagaacccaacgcggggcatcaagctatttcctactgggaggggagtgacaccgtcgaacacgttcacatcaccacccagaacattgacaacctgcacgagcgagctggctctagcgatgtgacacatcttcatggcagcttgtttgaatacaggtgctctgattgtgcgactccatgggaagacgataaaaactatccgcaagaacccattgcacgccttgctcctccacaatgtgaaaagtgcggagggctgattagaccaggtgtggtgtggtttggtgagaacctgcccgtagaagagtgggatattgcagagcaacgcatcgcagaagccgatctcatgatcattgtgggtacctccgggattgttcatcctgcagcagcactcccgcaattagcccaacaacgcggcgttcccatcgtggagatctccccaacgcgcaccgaacttagccggatcgcagacttcacctggatgtccaccgcagcccaagcgctaccagcgttgatgcgaggtttgagcgcctaacatgactgaagatgacttagatctgctgcaccgcacagtagaactagccacccaggcactcaagcagggaaacagtccttatggatccctgctggttgatcccttcggcgcggtcgtttttgaagaccacaaccgagatgccgatggggatctgaccaagcacccggaattcgccatcgccaaatatgcgatcgaaaattacagtgcatcagaacgtgctgcgtgcactgtttatacctcgacggaacattgcgcgatgtgcgccggtgcccatgcgtgggctggactgggcaaaatttactgcgccaccacaggtgggcaaacagccgcttggtacgcaaagtggggtgcagaatctgggcctttgaacccgatttcagcggacaaaattagcccgaacatatccatcgaaggacctgcttccagatttgaggaagtcctgtatgaactgcatcgatggttttatttagggcagtctccgaataaggctctttagcgctgggcatgtgactttaaaagcgcactaagagctcgtcaattctttaaaacaagctgagaatgtgaataataggataggttaacctgattcgattagaaaacggagatttgtcgtgcaatcccgcctgtccaaaatcctgcgcagtagcgtcgtaggcgttgctgtcctagccctgttagctgggtgttctaacaatgcagatgacaccgacgctgattcaacatccacgggaaactccgcttttcctgtttcgattgaacacgagttcggaaccaccacaatcgatgatgtacccgaaagagttgtcacccttggcgttaccgacgccgatattgtcctcgcattggggaccgtcccagtaggcaacaccggatacaaattcttcgaaaacggattgggaccgtggactgatgagttagtggaaggcaaagaattaacactgcttgactctgattccacaccagatcttgaacaagtagcagccctggagccagacctgattattggagtctctgcggggtttgacgacgttgtatacgagcaactatctgatatcgcaccggtggtcgcccgtccagcgggaacagctgcatacgcagtagctcgcgaggaagctaccaaccttgttgcccgtgcgatggggcaatcagaaaaaggacaagagctcaatgaggaaacagatgctctgatccaagctgcgcgtgatgaaaatccttcttttgacggtaaaacaggaaccgtcatcttgccataccagggtaaatacggtgcctacctgccaggcgatgcacggggacaattcctcgattcacttggcatttcgctgccggaagcagttctttcgcgagacaccggcgacagcttctttgtcgatgtccccgctgaaagcgtcaaagacgtagacggtgatgttctcctcgtgctttccaacgacgaaaatctggatatcacagcagagaatccactgtttgaaacactcaacgttgtgcaaaaagacgcagtaattgtggcaacaaccgaagaacgcggggcgattacctacaactcagtgctgtctgttccttttgcgttggaacatctcgcaccacgtattgctgaggctttgaagtaaaactcaactactcgagcacaatcaaaaaagaagcaccccggagaatctatccccggggtgctttttaaatgaggcacatgcctgccccagaagcccagcaaaaaactaaaccccacccacaaatccgagttgacgccatgcttcataggtcgctaccgccgcggaatttgaaaggttcatggaacgcctaccgggaagcatggggatccgaagctcactggtgattcgggaatgctcaacatgttcttgagggagtcctgttggttcagttccaaaaaggagtgcatcgccaggttcaaaagcgatatcggtgaagcgggtattggccgttgtggtgaaggcaaatacgcgaccagggactgcagccatggcttcatcgaaggttgcatgcactgtgacatcggctaagtcgtggtagtcaaggcctgctcggcgaaggtgcttttctgtcagctcaaagcctaaaggttcaacaaggtgcaggtgagcgcctgttcctgcacacattcggatggcgtttccggtgttgggagggatgacaggattgtcgaagataacgtgaagtgggtgttccggcatgtgtttgattgtaaggccttggaaaagggtggaataatagcgggcgtgactgcaatcaaacttgatggaaacttataccgcggggaaattttcgccgacttggaacagcgcgttgctgcgttgaaggagaaagggattgtgccggggcttgccaccgtgctggtgggtgatgacccagcgagccactcttacgtgaagatgaagcatcgtgactgtgagcagattggtgtgaactcgatccgtaaggatctgcctgctgatgtcacgcaggaagagcttttcgctgtcatcgatgaactgaacaacgatgattcttgcactggttacattgtgcagcttcctttgcctaagcacttggacgaaaacgctgtgctggagcgcattgatccagctaaggatgctgatggcctgcaccctgtaaacctgggcaagcttgtgctcaacgagccagctccactgccatgcaccccgaatggttccatcagcttgttgcgtcgtttcggcgttgagcttgatggcgcgaaggttgttgtcattggccgtggcgtcaccgttggtcgcccaattggcctgatgctgacccgccgttccgagaactccacggttactttgtgccacactggcacgaaggatctggctgcggagacccgtgcggctgacgtcatcattgctgcagctggtcagccgcacatgctgaccgcagacatggtcaagccaggcgcagcggtgctcgatgtcggcgtctcccgcaaggacggcaagttgcttggcgacgtccaccccgacgtgtgggaagtcgccggcgcggtctcaccaaacccaggcggcgttggccctctgacccgtgcattcttggtgcacaatgttgtcgagcgcgctgaaaagctggctggactctaaaaacacatgactaatcccggcaaaaagcacatcagtgaagagcaacttctggcgaatccccatgacggtggattagccccatcgaagtttcccatcaaggtgcaaaaagccgggattgtcgtattcgtactggcagtagtggcggcttcggcctttgctctcacagagcactggcgccgagccacattcacacttggtgcatcactgctgtatctttcgctactgcgtctgacctgtgactccaagattcttggagtgctcgcagtgcgatcgaggcgttttgatgccatctacaccgccattgttggcggattgatgacattccttgctacctcagtcgatgcgctgggcagctagattatttttcagagcgatcttccacagtttcatcgcgtgaaagcgcttcagcaatcgctgcaccctgagcggagccctgtgcatgtccagcagcacggccttggatgatctcagctagatcaatgccggtggtttgcttgactgattcaataatggatttcagtccaagtgcttgttcaccggcaaaacgtgaacccacggaattctcggatccttctccaccggagagcactgtcatggatccaatgtttgcgtatccagaggcgaagttgctcatgagttccggcaggatttccatggcttgctgggcgagtagtgcttcttggttttcgcggtaggcctcggcctttgccttgatagcgtctgcctctgcctgtcccttcaatcgaacagcttcggcttcagccattgcacgaacctttgcagcggtagcttcggcttctgcgatttcgacctgagcctgtgcgcgcctggtttgctcgaaagtatcggcttcgacttcctgcttgcggcggtagcgttcagcgtcggccaccttgttcacttcggcttccagctcgatctgcttattttcagcctgttggcgaagaacctctagtcgagctttttcatcggcaaggcgttcagcctgcatagcctgggcacgggcttcaccgacctgagcatcagcggcagccttgttggcatcaagttgggtctgttcaaccagatctgcctcttggttagcaatgcgtgatttagcgatcgcacgagcagcttcagtttctgcaatttccgcagcctgcttctttgcctgaatttccggtgcgccgagggatttgatgtatcccacatcatcggtgatgccacgaatctggaaggagtcaagaatcaaaccctgcttctctagctcggggatgactgtttcagcgatctgctcggagaattttttacgctcacgcatgagcgacgtgactgtttgctgcgccacgacaccacgaagcacaccttccagctgatcctgtgtgaaccgaacaatttctttgtcactggaagcgaagcgctgggcagcgcgacgaataaactcagcttcggaaccgatcttcaccagcgcaacagcctcgacattcaacgtgacattgtcatcgctttgtgccgtcacctgcatatttacctgacgggaacgcagagagatcttctggtgagtctgggtaataggcattaccacagctttgccgtggacaatgacctgcgattcccccttcttcttcgcagagacaatgagcgcttcatcagctgcagccaccttgatccaggtgcgtgaagttaagaagaaaataccgaggacaatgaccgcgacgacaagaatcgccccaatgacaaatagtatggcaatagcttccataaatgatcacttgctttctgtgttgctggtttctaaaaggactgggcggaaaagggcggtagtcaaagcggatgcacatgtagaaaatgacaaggcttcaaacacaagagcaaaactctttgccctaaccaaactactattttccgtttataaatcaccctatggtcattaatcgggtgcccctgaataagcccagttccggactggtaggaaacttaagagctgaaaaattagacggaatgaccgtagtagagagtgcctatttttgaaccacagaagctctgagcggaagtattcggcattgacaaactattcgagcacgactactcgagctattagatccaaactaaaccaatgccagttaaggtgactgaaaagaggtctgaatattggggactccccgtgcagagagttcagcgttttcaggcacgctctctttatagctgaagtcgagctcagggcctttcatctggaagaatgctgagccatctttctgctcattccaaatgatgtaggtatcactgaacgtatcagcgatttcttcttgctgttcagagccggaatcgccattggcaaggtcgatccagttggaggtcatctttaagaacagggtcttttgctcttcagtgagctgtgctcctcgcaaaccggatccttggagcgctgcctgctgggttggattgaggcttcccaccagttgttccgcagcttttttgatttgcgattccgaataggaggtatctaacgcctcagtgacactaacgacctcagctgggctcaggcccaaatgagcatccttgaaagtgatctgaccgtccggatcgaaagtgactttcaatccgacagttggtccatccagggtcaattcccaagaattctcggtggatggttcaggcgagaacttcagaaagtggtgtggattatcgccaggttcttgagctacatgctgaatcactgcagaaaccagctcgtatgcatgctcattgaagagggattccagcacacgcagcgcggtaacctggttggcccaggtcagcgtgctgatgtccaggccttcaccgagcaaggcggcgcgttgctcctcgtcaagatagtccaagaaacccagcgccgtcagcgaggtttcgcgtgaggcgttaaacgaggtttcattgcttatcgacgtctccccagtcgttgtctgcattgccgccgcaactttagtcggcggttcaggggagctcgtagcactggaagttacggaggtacatccgcttaatccgagagtgctggcgactagcgtggtagcaaaagcgccagcggcccgacgagagttcaacaaagtcacaactacttatgttagagattgttttttggtttatccggagggttgcctgtgagttgtttagagatccctgtctatttgtcgtaaatacctattagatgtagaactcgatgtaggtcgaagggttgtcttcgtctggggagatgaggctgaagaagttcctcacgatgcgatccatttggcggctttcggtgaggaaagcatcgtggccgacaggggatacgatttttgccattgccagtagatttcccaggtttctggagaggtgttcttgctggtggtaggggtacaaaatatcggtatctacgcctgcgacaaggactggaactttgatggattcgagtgccttgttgaggcctccgcggtcgcgaccaatgtcgtggcggttgagggcgtcggtgagcaagacgtaggagccggcgtcgaaacgctgtactagcttgtctgcttggtagtccaagtaggattccacggcgaagcgctggtcgggcttgcggtagggaccgagtgggttttcgttcttttgggctttggtgccgaagcgttcgtcgatttctagttcgccacggtaggtgaggtgggcgatgcgtcgggcggcgccgagtccggtggctgggttgcagccggattcgtagtagttgccttcgtgccagtggtggtcgttttcaatcgccttaatttgggcggattgaatgccgatttgccaggcgctggcgcgtgcagaaactgcaagaacagcagctgcgccaacagtttctgggtacattgcggcccactctagggtgcgggcaccacccatggaaccaccaagtactgcggcgaccgtggtgatgccgagtgcgtcgaggaattgtttttcggcgtttacctgatcacgaatggacgtggcggggaagcgattaccccagaaatttccatctggatgcatggagccaggtccggtggaaccgttgcaaccaccgatgacgttggtacagatcacgcagtaaatatcagtgttgatggctttgccgggaccgagcaagtcagcccaccaatcggctgcgttggaatctccagtgagggcgtgttcgatgagaacgacattgctgcgtccttctttatctacgcggtattcaccccagcggtgataggcgatttcagcgtttgtaatgattgctccggcttcggtggagacatcaccgatcgcttggatttcaagttgacctgaaggcgcgagggtgggcatgaaaataaccgcctgttctgggtggacaagactaaaacttcgtccagtgtatatggacagctctgtctagtctagtttgcattctcacgagtctgaaaaagaaaaacccagcgctttaagcactggggtgagtctatttaaagctagattgcagcaaagccgccttcgaggtcagcgatgatatcatcaatggtctcgatgccaacggacaggcggacggtggactgggtaacgcccgcgcgtgccaggccagcttcgtcggactgtgaatgggtggtggttgctgggtgaacaacgagggagcgaacatcgccgatgtttgcaaggttggagtgtagcttcagggcgtcgataaatgcccaagcctcatccttgccgcccttgatctcgaaggtgagaacggagccggtgtacttcaggccaagcttttccttggttgcgtaccaaggggaatccttcaggcctgcgaagttaaccttttccaccttctcgtggttgttgaggaattctgcaaccttgatggcgttttcgttgtggcgctccaggcgcagggaaagggtgtcgatgccctggactgcagcccatgcgttgaatgcggagagggtggagccggtgtcgcgtagaaggccaacgcgaaccttgaggccgaaggctggtgcaccaaggtctgcgtacttcaatccgtggtaagcagcatctggagtgacgaagtaggggaatactggctttccatccttttcgacagtccaatcgaactttccgccgtcgataagcacgccgcccagtccggagccgttgccggtgtagaacttggtgagggaagcgacgacaacgtctgcgccgagctcgagcgggcgcacgagcgctgcggtagcgatggtgttgtcgatgatcagtggaacgctgttgcggtgcgcaacttcagccaccgcaggaatatccaggacgtctgcctgtgggttggcgaaagtctcgccgaagaatgctttggtgtttggctgaacggctgcctgccaggactcagggtcgtcggggttttccacgaaggaaacatcgatacccaggcggttaagagtgataaggaatagagtctcggtgccaccgtagaggcgtggggaggtgacgatgtggtcgcccgctcctgccaggttcaaaatggcgttggtggttgcggcctgtccggaggagaacgctacagcgtggacgccaccttcgagggaagcgatgcggttttccaaagcctcaacggttgggttggtgaggcgggagtaaacagggcctagatcctcaagtgcgaaacgctgcttggcgtgctcagcggagtcgaacacgaaagcggtggattggtagatcggaaggtttcgtgcgctggtctgtgcgtctactgactggcctgcgtgaatggagcgggtttcaaagccccactggtcagcattggaattgtcgtactttggcatttggaggtccttaagagtttttattaggaaattcttctcccatgcaccctactgaacagcttggtctattgcaatagactgtgtggtataaatttattctcgggtaattttcttgactttttccaactgatttgaaatcgattgcgtacagctagggttatgggggtatgactagccccactctaaatggtgcaggatggtataaatcatctctcaatgttacttttccattgttaagaattaacaactctcggtgatttgtcgcatacccagctgtcaaagatccgatcatcggcatacagaaacacccatctggccgaactttcctttttctgcatgcatttctgcacacagtttctgcccgctgtttctacgcatagtggctttgaaacgacccgaagagaaaacagtaaagatcgtgaccataaaacagactgacaacatcaatgacgatgatttggtgtacagcaacgctactgaccttccagtaggcgtgaagaagtcccctaaaatgtcaccgaccgcccgcgttggtctccttgtctttggggttatcgcggcggtgggttggggagcaatcgctttctcccgtggcgaaacaatcaactctgtgtggctggttttggcggcagttggttcctatatcattgcgttttctttctatgcccgactgattgaatacaaagttgttaagccgaaagatcagcgagcaaccccggcggaatacgttaatgacggcaaggactatgtcccaacggatcgtcgtgtgctttttggccaccactttgcagctattgcaggtgccggtccattggttggacctgtcatggccgcgcagatgggctacctgccaggcaccttgtggattatcctcggtgtgattttcgccggtgcagtgcaggactacctagtgctgtgggtgtctactcgtaggcgtggacgctcacttggccagatggttcgtgatgaaatgggcacggtcggtggagctgccggtatcttggcgaccatctccatcatgatcatcattatcgcggtgctcgcattgatcgtggttaatgcactggctgattcaccatggggcgttttctccatcaccatgaccatcccaattgcactgttcatgggtgtgtacttgcgttacctgcgcccaggtcgtgttactgaagtgtccatcatcggtgtggcactgctcctgctggctatcgttgctggtggttgggttgcagacacctcatggggcgtggaatggttcacctggtctaagaccactttggcgttggccttgatcggttacggaatcatggctgcgattttgccggtgtggctgctgcttgcaccgcgcgattacctgtctacctttatgaagatcggcgtcatcggtctgttggcagtgggtattttgttcgcacgtcctgaggtgcagatgccttccgtgacctccttcgcacttgagggcaacggtccggtgttctctggaagtctgttcccattcctgttcatcacgattgcctgtggtgcactgtctggtttccacgcactgatttcttcaggaaccacaccaaagcttgtggagaaggaatcccagatgcgcatgctcggctacggcggcatgttgatggaatctttcgtggcgatgatggcactgatcaccgctgttattctggatcgtcacctgtacttctccatgaacgctccgctggcactgactggtggagatccagcaaccgcagctgagtgggttaactccattgggctgacaggtgcggatatcaccccggaacagctgtcggaagctgctgaaagtgtcggagaatccactgttatttcccgtaccggtggcgcaccaaccttggcgttcggtatgtctgaaatcctctccggattcatcggcggcgctggaatgaaggcgttctggtaccacttcgccatcatgtttgaggctctgttcatcctcactactgtggatgcaggtactcgtgtggctcgctttatgatgaccgataccttgggcaatgttccaggtctgcgccgtttcaaggatccttcatggactgtcggtaactggatttctaccgtgtttgtgtgtgctctatggggtgctattttgctcatgggtgttaccgatccactgggcggcatcaacgtgcttttcccactattcggtatcgctaaccagctgctcgccgctattgcacttgctctcgtgctggttgttgtggtgaagaagggcctgtacaagtgggcgtggattccagctgttcctttggcatgggatctcattgtcacgatgactgcgtcatggcagaagattttccactctgatccggctattggctactgggctcagaacgcgaacttccgcgatgcaaagtctcaaggccttaccgaatttggtgccgctaaatctcctgaggcaatcgatgcggttatccgaaacaccatgattcagggcatcttgtccatcctgttcgcggtgctcgtcctcgttgttgtcggcgcagccattgcggtgtgcatcaagtccatcagggctcgtgcagccggaacacctttggagaccactgaagagcctgatactgaatctgagttcttcgccccaactggattccttgcatcttccagggataaggaagtccaggccatgtgggacgagcgctacccaggcggtgcgcccgtgtcttctggagggcactaaaacatgatggctcttactcatgcactgtggaaaatcccgcgggcggtgtggtggtatctcactgagctcatgggggacacggcgtattccaagtatgtggtgcacttaaagcaccaccatccggatgctccgattcctactgagcgggagtattggcgggcaaagtatgcagatcaggacgctaatcctggtgcccgctgctgctagataaaacgaaaaggcgcgttgattcttaactgagtcaacgcgccttttatctgtggcaggaagcgattagccgcgaaccaaaccaggtgaccgaaaaacttccgccactcaattttcggccacataggacagttatcagcgctcgaaaccagtccatatgaccgaagaactctcaaaacttctcccgtaggtcacctggtttggaatgaagagcgaggccaccccaaaaaagactttgcttatcgacgcctccctccagcgtccaagaatatgcccccgcgcgccgggtggggagcgaagggaacccccaaggaattggcgttgaggtggtgattttgcatgttttactcaaaatcactttgatggtcacaaaattacacaacttttacagtgacctacattgctttttaaagaattagtgtggtgtgcaacattagttcgttgagaaggagtcacattccagccatgattaaccacgaagtgcgcacccaccgttctgcggaagagttcccgtacgaggagcacctggctcacaagatcgctcgcgttgcagccgacccagttgaggttgctgcggacactcaggaaatgatcatcaaccgcatcatcgacaatgcatcggtgcaggcagcttccgtgttgcgtcgaccagttagctctgcccgtgcgatggcacaggtcaggccagttaccgatggtcggggtgcatctgttttcggtctgccaggacgttatgccgcggaatgggctgcgcttgctaacggcactgcggtgcgtgagcttgatttccatgacacgttcctcgctgcggaatactcccacccaggagataacattcctccgattttggctgcagcacagcaggctggaaaaggtggcaaggatctgatccgtggcatcgctactgggtatgagattcaggttaacttggtgcgtggaatgtgcctgcatgagcacaagattgatcacgttgctcatcttggaccatcagcggctgctggtatcggaaccttgctagacctagatgtggaacaccatctaccaggcaattggtcaggcattgcacaccaccacggcgacgaggcagtcccgtaaaggtgcgatttcttcatggaaggcatttgctcctgcgtttgcgggcaagatgtccatcgaggcagtagatcgcgcaatgcgtggcgagggcgcaccgtcaccaatctgggaaggcgaagacggcgtaatcgcgtggctgctgtccggtcttgatcacatctacaccattcctttgcctgcagaaggtgaagccaaacgagcaatcttggatacctacaccaaggaacactcggcggaataccagtcacaggcaccgatcgacttggcgcgcagcatgggggagaagctggcagcacagggcttggacctgcgtgatgtggactccatcgttttgcacacctcccaccacactcactacgtgatcggcaccggatctaatgatccacagaagttcgatccagatgcatcgcgagaaacccttgatcactccatcatgtacattttcgctgtcgcgctggaggatcgcgcgtggcaccacgagcgttcctatgctcctgagcgagcccaccgccgagagaccatcgagctgtggaacaagatttccacggtggaggatcctgaatggaccaggcgttaccactccgttgatcctgcagaaaaggccttcggcgcacgcgcagtgatcaccttcaaggatggaaccgtcgtggaagatgaactggctgtggcggatgcgcatcctctgggagcacggcctttcgctagggagcagtacattcagaaattccgcaccttggctgaaggtgttgtgtccgaaaaggaacaggatcgcttcttggatgcggcacagcgtacgcacgagcttgaggatctttcagaactcaacattgaattggatgccgatattttggccaaggctcctgtgattccggaaggactgttctgatggcgggtttgttttcctctgctgttgcaccaacggagcgtcgaaaagcattacgcgcggcactggctgcgcctgaaattgcccgcatgcctggtgcattctccccgctggcggcgcgcgcaatccaggaagccggatttgaaggcgtgtacgtctcgggcgccgtcgtggcggctgaccttgcattgccggatatcggcttgaccacattgaccgaagtggcgcaccgctcccggcagatcgcacgcgtgacagacttgcccgtgctggtcgacgccgacaccggcttcggcgaacccatgtccgcagcgcgcaccgtctccgaactcgaagatgcaggtgtcgcgggctgccacctggaagatcaagtcaaccccaaacgctgtgggcacctggacggaaaagaagtagtgggcacggacatcatggttcgtcgcatcgccgcagctgtcaacgagcgtcgcgatgagcaattcgtcatctgcgctcgcaccgacgccgcgggagtggaaggcatcgactccgcgatcgagcgcgccaaagcttacgcggatgccggcgccgacatgatcttcaccgaagcgctgtacagccctgcagattttgaaaaattccgcgcggccgtcgacattccgctgctggccaacatgacggaatttggcaaaaccgaacttctgcccgcgcagcttctggaagacatcggatacaacgcagtgatctacccagtgaccctgctgcgcattgcgatgggacaggtcgaacaagctctcggcgacattgcaaacaccggaatccaaaccgactgggtcgaccggatgcaacaccgatccaggctgtatgagctgctgcgctacaacgagtacaacgctttcgaccagcaagtattcacctattccgctgacagctacaagcccatcttctaacccgcctatatataaggagtgaatcaccatgtccagcgccacaaccactgatgttcgcaaagggctctacggagtcatcgccgattacacggccgtttccaaagtcatgccagagaccaattcactgacctaccgtggctacgcggtggaagatttggtggaaaactgcagcttcgaggaggtgttttacctcctgtggcacggcgagctgcccactgcgcaacaacttgcggagttcaatgagcgtggccgttcctaccgctccctggatgccggtttgatctccctgatccactctttgcccaaagaagcccacccgatggatgttatgcgcaccgcggtgtcctacatgggcaccaaggattccgagtatttcaccaccgattctgagcacatccgcaaagttggccacaccttgttggcgcagcttccgatggtgctagccatggatattcgtcgccgcaagggcctcgatatcatcgcccctgactccagcaagtcagtcgccgaaaacctgctgtctatggtgtttggtactggcccggaatcacctgcatccaacccagctgacgtccgcgattttgagaaatcactgatcctctacgccgagcactccttcaacgcctccaccttcaccgcccgcgtgatcacctccaccaaatcggatgtgtactccgcaatcaccggcgcgatcggtgctctcaagggcccattgcacggtggcgccaacgagtttgtcatgcacaccatgttggcgatcgacgatcccaacaaggccgccgcctggatcaacaacgctttggacaacaagaatgtggtcatgggctttggccaccgcgtgtacaagcgcggcgattcccgcgtgccatcaatggagaagtccttccgggaattagctgcccgccacgacggcgaaaagtgggttgccatgtatgaaaacatgcgcgacgccatggacgcccgcaccggcatcaagccgaatctcgatttccctgctggccctgcctaccacctgctcggtttcccggtcgatttcttcaccccgctgttcgtcatcgcccgcgtcgccggctggacggcccacatcgtggagcagtacgaaaacaactcgctcatccgcccactgtccgagtacaacggcgaggagcagcgcgaggtcgcgcccattgaaaagcgctaaaagattttcgcttttcgacgccccctcccactcatttcagccatggtgcaacattctcgtccccaccatgttcttctgactcccgggaagaacatgtttcgccaccgcttcgcgccacacgtaaaaatgcggcgcgcagcggtgggcatcaagagccgcttgatccgcgtaaagttcgaagaaactgaaatgaagctcatcatcaacatcttgtgaaacgtcgaaatacacgcaaccttcttcatcctgaaagctgcgctgcgcattctccgaaatggcgttgaggaattcctctagatggccaggtttaacgcgcagatcaacggtgagttacaacatggttctcgattgccagttcttgcagttccatccacgttttttcaggcaatgaaataccgtgcgcagagtttttccgatgcgcacggtcttccgattcaccggggtagaaaatctcctcggtgttttgtgctttcggagtggatttaacttccccaaccagatcgctgagtgcgtcatcgaaatcttgtggatcgcgaaacgctgcaacatccaacgcgatgaacaagtggccagctccacctgggggagtgggatcatacggaccatgtaccttggtgctgtgctgggaaccagtgagaactccagaaagcacatccatcatgaagctaatcgcataacctttgtgaccagccatgggaaggacgacaccgttgattgcctcagcaggatccgtggtgggtgcgccctcactcgtgatcgcccaagtctcaggaatgggcatgtttgtctgtcgtgcgtggtagatctttccgcgcgcaaccgcagtattggctatatcgactaccgtagccgtttctccaaaaggtgccgcaatagaccatgggttggtaccgatccgtttttctctgccaccccagggcgccatcgccggagatgcattggtggtgagaatggaaacacatccttgcgctgccgctttccgggtgtagtacatggcagttccaaaatgattggagttgcgcaccgacaccgcaccgatgccgaacatcattgccctagtcactgcttctttacgagcatgatcagctaaaacttggccgattccattgtgtccatccaacgccaacacggcacccaaatcattgagaacctccacgtgtgcatgtgtagtcatcgcgccactgtggagtctgcgcacataccaaggcagtcgaagcacaccgtgggaggggtgaccccaaagatcagcctgcaccaaactatcaccgacaagatgggcgtctgctgcaggtactccagttttggtgaggatgtctgtgcagagaacagtgagttgttgggcgttgacagtgacttctggcatgaatccctcaattcggtttaggtataccgaaatgtataccagcaataggtataggcgcaaccccctttaatcgccatcagtgcacgctggttctaagacctaatatcaatgccctgcgagcccgtagaatcagcattaatcaatgcggtcaaaatgctcttttctacatggatcaggtgctgtctacacgcagcgcctgccgaccttaaatctcctgaggccacagcttcacacatttcaatatgttcctgaaccgattggcgcagacgcgcatgatcggaatgcgcaatgatccgcagcctcgtggtgtgcggttttaaacttaagatgctgcgtccaaggaattggttgtgagtatttgctgcaacaagatcatcaaacttactggtcaatcgcctaaaatcggcggtgaaatctgcatcgtctgcagagttttccagctctcgaaaatctgccgccaacgtagaaaactcaccaaagatacgcggtgatttactcgctccaacagagatttcctcaagcgctgcgacctcgacgatcctgcggaactcaaacagatccttaatgtggcgaagcgaaagtggcgacaccataggcgcctgacgtggctccaaaatgatcaactcgtctgcggctaaccggcggagagcatcccggactggggttctcgaagcgccggtgtgttcaaccagccacacttccgacattcgttgcccaggatttaaggttccatcttcgatttcacgacgaatctgtgtgtatacctgatctgcttttctcgtagcaggggaggcctgggcatctttttggaccatgacaacaccttagtacaccgaaatttagactatttgtgacactgggttgcagaaagtggatgctaggttgggggagacgtcgacaagcaattttttgcttggcgtattactggctgtgcttggactgcttccttgagttagtccacgccctgatcccgaggacgatgaccgccaaagcgatggcgcctccaatcaggatgtactgcagtgggattgggcgggcgtcatcgatggcatcgatgcagttttggaaatcctctttaagagcggtttgggattcgttgtaatcatcggtgcggtcggcgaatacttcggcgcggatttctgcggtgcgggtgccggtggtggcggcttgttgaagttggctgagtacatcgctggctggatcgctggagaatccgctgatgatgtctttggcttcgtcgtatgtgtactccgttttgaaactttcctcggcgttggggtctgccagcgtgggatcgtctgggaggagcatggctaggccttcgccggattcgatggcatcgaggcgtacttgcagttcagcagcagttggggcgttgtcatcttgggcgatgtagctttcaatcgccgctttgattcctggatcttgggcgtctagttcgtcgaggcgttgttcgcgcacggagtcttcaatggagttccagaaggtaaccaccgcggaatcgtcggtgttgctggcgatgcacaattccttgtcggtgtcggcggtgagtgtggcagcagatgctgttgggatgctcacggcggtggtgataagaagtgcgggaagaactcgagaaaaacgcatgtgcccattatggcaataaaaatatgaaaaagcgctgtgcttccatgtgaggaagcacagcgctttttgtgaagagactttacttcttcagtgcgtcaacgatctcgttgaactgtgcgactgggcgcatgatgttggtgagcttctcctcgttaggggagtagtagccaccaaggtcagttgctccaccctgaactgcgagcagtgcagcatcgatgtctgcagcgcctgtgttcagtgcttctgcgactggtgcgaaggtagcagccagatctgcgtcctcggtctgagcagcgagctcgtcagcccagaacttggtcagccagaagtgggagccacggttgtcgatctcgccaaccttgcgggatggggacttctcttcgttcagcagcttctcagttgccttgtccagagcgtcagccagaacgccggccttggtgttgccgttgttgttgagctcgtggcggaaggactcagccagtgcgaggaactcaccgagggaatcccaacgcaggtggttttcttcctgaacctgctggacgtgcttaggagcagatccaccagcaccggtctcgaacagtccgccgccagccatcaaaggaacgacagacagcatctttgcagaggtgcccagctccaggattgggaagaggtcggtgttgtagtcacgcagaacgttaccggtgacagagatggtgtcctcgccacggcggatgcggtcgatggagagctgggttgcctcaacaggggagaggatctggatgtccaggccctcggtgtcgtggtcagccaggtacttctcaacgagggaagccaggttgcggtcgtgtgcgcgctctggatccaaccagaacactgcaggcattccggagagacgggagcgggtgacagcaagctttacccaatcctggattggggcatccttgacctggcatgcacgccagatgtcatttgcctcaacgtcgtgctcgatgagaacgtcgccgttggaggaaacaacctgaaccacaccgtctgcttcgatgcggaaggtcttgtcatgggagccgtactcttcagccttctgagccatcagaccaacgttagggacggtacccatggtggttggatcgaatgcgccgttcttgcggcagtcttcgataacggtctggtagacgccagcgtaggaggagtctgggatgattgccagggtgtcctgctcctggtcgtctttgttccacatgtggccggaggtacgaatcattgctggcatggaagcgtccacgatgacatcggaagggacatgcaggttggtgatgccgcgagcggagttaaccatggccaggtctgggccgtcttccaagcccttctcgaatgcagccttgatttcttcgccgttgtccagggactccaagccggagaggattgcagcgaggccgttttcgccgttgaggccagctgcgagcagctgctcaccgtactgtgcgaaaacgtctgcgaagtaagcgcgcacaacgtggccgaagatgattgggtcggagaccttcatcatggtggccttcaggtgtgcggagaagaggataccttctgcctttgcgcgagcgacctgctcgagaaggaatgcgtccagtgcctttgcggacagaacggttccgtctagaacttcgccttcaagaagcttgaggctgtccttgaggatggtctcggtgccgtcagctgcgatgtgcttgatctgaacttcatcagcagcgtcgaggatgatggacttctcgttgtggcggaagtcgtttgcatccatggttgcaacgttggtcttggaatctgcagaccactcgcccatgcggtgtgggaacttcttaacaaagttcttgacagcgattggtgcgcggcggtcagagttgccttcacgcagcactgggttcacagcggaacccttaacagcgttgtagcgtgcgaggatgtctttttcctcgtcggtggtggcgttatcaggcagttctgggatgtcgtagccctggtcctgcagttccttaatagcagccttgagctgtggaacagaagcggagatgtttggaagcttaatgatgtttgcttcaggagtcttagcaagctcgccgagttctgcgagtgcgttgcctaccttctgatcttcggtgaggcgctctgggaactgggcgaggatgcgtccagcgagtgaaatgtcccgggtctcgacctcaatgcccgcggtagcagcaaatgcctcgacgaccggcttcagcgagtaggtcgcgagcagcggtgcttcgtcggtgcgggtccagatgatcttagccatgagtctccttggttgatgggctcttttgttcagctacctagaatacagtgttctactaattgctggcgcctatggtggcagtttcagccccgcatggaaacgccgtgtttccaataccccatgaatgccacttgggaacggtcgaggcctttctctttcactagagatcgacgaatgctggtcacgacaccactttcgccagcaatccagtagtagtcgcctgaacgtgggttggattctgtgatctgttcgccagtggcggagaacacaggagtctcccacacaagttcgccttcggaggtggctgcagcttctgtttcttcatggtggagggccagggtttccatcaacaattcaccgtgcttgcggccgttgcggggcagccatttcacatcgatggaggaaggtccctcgatggcaagtgcatcgtcatctgaggggatttcgatcatggcggttcctggaatatcggaatctgcgaggtcttcgaggatgcgcgcgattgcgggtgctgcggtttcatcgcctgccaagatcaccttggtggctgcaccgggagcgaattcaatgccacccatatattcagcatcgagtcgtggtgccacaatcaaaatttcatcaccagctgcagcagacgccgcccacgtggatgcaggtccggtgagccccggcgcgatgtggaggacgaaatcgacggtcatgcgggtggcttcttcggtgcgctccagtgagcggatggagtaggtgcgcatgacgccgcgggagtcttcgggaagtttggcccattcttcgtaccagagtccttcttgggggaattcaggtaggggttggccggggttgggaaaaatgagtttgatgcgctgatcgtaaagcggtgtgtcgctgcccaccactttgagttctggtccggtgaacacaatccggatgaagttggggctgatctgggttgcggattcaacgatggcggttactggggcgggcatggtgttctcctagtgaagtgcggtgatgtggtgtcgtcccatgggcatgaccagtggtgcgccggagactgggtcggcgataatgcgggcgtcggtgtggaagacctcgctcatcatggtttcggtgatgacgttggtgggggtgccttgggcgtagatttttccggcgttcatggcgatgaggtggtcagagtaacgtgcggcaagtcccaattcgtggagcaccatgacgatggtggtgccgtggttgtggttgaggtcagtgaggagatcaagcacttcgagctggttggcgatgtcgaggtaggtggtgggttcatcaagaagcaggatgtctgtttcttgggcaagggccatggcgatccagacgcgttggcgttggccgccggagagttcgtcgatggggcgttcggcaagctcggtggtgttggtcatttccaatgcttgggccactacttcgtagtcgcgtgtggaccatctgcccatgagtccttggtgggggtggcggccgcggcccacgaggtcggcgacgacgatgccttcaggtgcggtgggggattgcggtaacagcccgagcatgcgagctagttctttgcctggcagtgaaggaagggggtgggcgtcgataagcgcttgcccggcgctaggtttaaggaggcgcgcaaaggcgcgcagcagcgttgatttgccgcatccgttggggccgacgatggaggtgattttgccggggacgatgtcgacgctgagcgaatcgatgatggtgcgctcgccgtacgccagggaaatttcttcggcggatagttgatggttggtggtcacagggttactcccgcgcggttggaacgaatgagtaaatagataaggaatggggcgccgaatgcgccggtgacaactccgacggggtagcgggtgccgaggaagtattggccaattaggtcggcgatgagcacgatcaacccgccgatgagtgcggaggggatgatgagcgatccgccggagcctaaaatgcgcgcggcaatggggccagacacaaacgccacgaatgcgatcgggccgcatgcagcggtagcaacggcgatgagcgcaacagcggcaataatcgcaatgacgcgcgtgcgattagtagcaacgcccaaacccaccgcggaatcattgcccaaacgcataagatccacattgcgcgcattagccaccagcagcggaatgagtaccacagtggtgacaatcagcggcatcgcacgatcccacgtcgcaccattgagcgagccggtaagccagcgcgtcgcggtcggcagatcccaagaatcagccttggacagcgaatacgacactaatgaattcagcatcgcagcaataccaatgccggtaagaatcagacgcgtggccgaaaaaccaccgcgatacgccaccagataaatcaacaacgccacagccaaggacgcacacaaagaaatcgccgacactgcagactgcgacatcccgaaaaacacaatgcaaattacgcccgccgccgacgcgccagaagaaatgccgataatatccggcgacgccaactgattacgcaacaccgtctgaaaaatcacgcccgccgcgccaaacgccaaacccgcagtcaaacccatcaccgcgcgcggcaaacgcaacacgccaacggaataactcgcgccgggaacctgctgtccagacaacactttcagcacctgagcagggccataaaacacctcgccccacatcaaagaaaaagcaaaaataccaagcgtgacgacgcccaatgccgcaacaatcagccacctgcgggagttgcgcgatgcgcgctggcgcttgagttgatggctaaggctcatagctctttgactttctgacgacgaataatccaaataaacagtggcgcaccaatgatcggcatgatgatgcccacggcaatttcactcggacgagtcaccacgcgcccaaaagtatccgccgcaacaatcaacaccgcgcccgctagcgccgaacagggcaccagccagcgatgatccgtgcccacaatcaggcgcgtaatgtgcggcaccaccagccccacgaacgcgatcgggccggccagcgccgtagccacgccgcacaaaataacagcgcctatcgacgccacaatccgtgttctcagcacattctcacctaaactggtggccacatcatcacccaacgccaacgcgttcaaaccagtggatgtgagcacacacagcaagaaaccgacagcgagaaacggtgcagccagggccattcgatcccactctgcgccacccacgccaccgatctgccaaaagcggaatctgtccatgacatcaacgcgaggcaacaacacagcactgaccaaggacgtgagcgcagcggtggtggctgcacctgcaagagcaagcttgagcggcgtggccccaccgcgacccaaagaacccacggtgtacacaaacaccgcagcagccgcagaaccaacgaccgcaacgatcatcgtggggaccgcgccagccaaaccgaaaaaggaaatgccaatgaccacagccagagaagcaccagcaagaatgccaaagatacctggatctgccagcggattcctggtcaccgcctgcatggtggttcccgcaatcgccagggcagcaccaatgatgatgcccagcacagtccgtggaattctctttaatgctgctgcttgctccgtggtgtccgaatgcccaagcaatgcctggatcgcatcatcagtgctggtggaacgcacaccaaatttcacagagcacacgcacgcaacagctaaaagaaccagcgtggcgctgagaaacaaaagctttttggttgttgacatcaagcagttttacttcagaggttcggcgagttttgcaaagtaatcgttgataccccaaggaatagatagtggggattcattcgctgaagcagccagtgggttagcacccaagaacacaaccttgccctcggcgatagctgggattcgagacagcagtggatcagcctgcatcttggacaacagctcagcgtttgcagcatcatcttcggtgccgtaggtgatgatcacatcaacatcgtcgaaggtttcagggttttctgcagaaacctgctcgtagaagctatctgggctggagtgctccttgaggactgaagcttcctggacacccgcatcaagcaagaagctcatgcgaggatcaatgctggtgtacacaccaatctgcgagaaatcgctctcatcgaagaacgcgaatacaggcttcgcatccttcaactctgggttggcatcgatggcggaagcaacctctgcatccagatctgcgatgagatccttgccttcttgctccaagccaatcgccttagagttcatctcaatcatttcatccagggaggtgccccatgcgatttctgggtaggcaaccacaggtgcgatctgggacagctgatcgtagtcttcctgggtgatgccagagtaggacgccaaaatgacatccggagcagtgttggcgatctcctcaaaaggaatggaatcggtggcatcgaaaagcacaggctcatcggagccgagcttgctcaaggtttcttccacccatggcaagatgccgttgttgtcatcgtcgccccacgtgaccttctcaaagccgacaggagtcacacccaatgcgagagggacttcatggttggaccagccaacagttgcgatgcgttctggcttggactcaatggtggtctcgccgaaagcgtgctcaatggtgacagggaacgcctcgttggaaacgtcagagctttgggatgctgctgaagacgaattggaggacgtttctgaagaatcctgggagcaggccgcgagggacaccgtgagggttgcggcaagaatgccggctagaacgcgagacgtacgcatgaaaagtttctctctctttctcgaacaacaacggaataacttaggttaggctgcccgacagaatatcactggagaggtattggaggaaatgtctcacgtcacaaccttttgaaaggtggctaagtacgcacatttgttgtctgcaatagtgccggtgagggagctgtccgatattgtgcttacatgcacgaatctggaaaaaatcctgtcaaggttgtcgactcgcaggcaccacaaggacgcggtgggcatatcggcggacatatcaaacgccgcccgattcctaggcaaacggaaatttccgaggttcgtcgatatatcgtcatgactgccctcgcactcggtggcttcgccatcggtgtgacggaatttgtctccatgggtctgctcagcgcgatcgcctccgactttgagatctccgaagaccaagccggacacatcatcaccatctacgccctcggcgtggttgtgggtgccccgctgatcacagcgtttaccggcaaacttccacgacgccgcctgctgctcatcctggtggccttctttgtggtgggtaacgcgttgtccacactgaatgcgtcctatgaagtcctgttgattgcccgcttcatcgctggtctgccacacggcgcgtacttctcagttgcaggtttggcagcagcatcgatggcaccagacggacagcgtggacgtgcgatcgcctatgtcggtatgggtctttccgtgggtactgtcgccggtgttccagcagcccaagcactgggcgatgctttcggttggtccaccgcctacgtgctggtcaccgtcctgggtgttctcaccttgctggccctatggttcctcatgccacacatgacagagatgaaacccaccagcccgctgacagaactcagtgctttgaagaacagccaggtctggctcaccctgggcattggttccatcggtttcggtggcatgttcgcggtctacacctacatctcttggaccatgaccgaccaagctggcatgccaagctccctgatctggattgtgctgatggcctacggcgtgggcatgatctgcggaaactacgtcggtggacgcatcgccgactggaacgtggaccgcggaatcctcctcgcactgatctgcatcgtggtggccctcatcggtttctacttcacctccaacaacgccatcctgggaaccatcaacttcggactcgtcggattcttcggctccacactgatcccatcactgcagatccgactcatggacgttgcaggacgcgcacaaacgttggctgcatctctgaatcaatctgcactgaatatcggtaacgctttgggcgcagcgatcggtggcgtggttatcggcgcgggttattcctacagcactccagcccttgctggcgctggcctggcattccttgccatcgtggtgtggttccccatggtggccttgcgtaaacgcacataaacggggttggcggatggaggatttccccaagcacccactagtgtgacaagcatgagttttcacatcacatccgtcaatgtcaacggcattagggcagcggtcaaacagcgaagcgaaacaaacctaggtttccttccgtggcttgaagaaactcgcccggacgttgtcctcctccaagaagtccgcgcaagcgaaaaagacaccgccaccgcactgcaacccgccttagataacggatggcactacattggtgccccagcagctgccaagggacgtgccggtgtcggcattttgtctaggcatgaacttgaagatgtgaacatcggttttggatctttccttgactccggccgctacattgaagcaaccatcaaagacaccaccctggatgtgccagtaaccgtggcatctctttacctcccctcaggttcagcgggcaccgacaagcaggatgaaaagtaccgcttcctcgatgaattcgaagggttcctggaccagcgcgctaaagaacgctcccacatggtcatcggtggcgactggaacatctgccaccgccgcgaagacctgaaaaactggaaaaccaaccaaaagaaatccggtttccttcccgacgaacgcgcattcatggattcagtctttggcaccttcccagatgaggcaacccaggttgcaggggccggcgacttcttcggtgccgtggactatgaaggaacgaggcgtcgagaagcaactacggaccctgcgtggttcgacgttgcacgtcgcctgcaacctgaaggcgacggcccctacacttggtggacctaccgcggaaaagccttcgacaccggcgccggatggcgcatcgactaccaagcagcaaccgcagcgatgctcgaacgcgcagaacgctcctgggtagacaaagccgctgcatacgatttgcgctggtcagatcactcaccactgaacgtgatctactcctaaaatgctgctgacaattctatgggccatcggcatcaccgccgaaggcatgacaggcgcgctggccgcaggccgacaaaaaatggatctcttcggagtatccgtcatcgcatgcgttaccgcgatcggcggcggatccatccgcgacatgctgctgggacattacccgctggtgtgggtggaaaagccactgtatctactgctgatcattggcgcagccattttgacagtgtccatttccttcctgatggagcacttccgtgtgttgttcctcgtgctcgacgccgtgggtctttctgcattcgctgtgatcggcacacaaatcgcactggaaatgggctacggattcatcatcgcagtagtggcatcagtgctcacaggtgtattcggcggcgtcatgcgtgaccttttgtgtgaccgcatcccactggtatttcaaaaagagctctacgcatcaatcgcattcctcgccacctgcgtctactttgcgatgatgtaccttggagcttccgaaaacgtcaccgtcctggtctctgtggtggttgcctttgtagtccgactgctatccatctggcgcggatggagcctccccgtattcgactaccaagaacgcgaatacaaacgagatcccaaaatgcgtctgtggagaatgttccggaagtaaggattttgcactcgggggaaaattttactacccctaattgcagaagttccttaaaatacgggtaaggtcagatcagaaaacttcaatgaggatgtatcaacttttctcaagctgatacgaaaagtaaggattgtacatgggtaagtcattcgcccttctagttcttggcgctatcatcttggccggtggtgtctggtacaccatcgaggttgggtactccgtgatggcaattgttgccgcactgatcatggctgccggtggcggaatcatcacctggggtctcgcagtggctgcagatgtaaattcaccaacctcacacaagatctaaaacagacgcccctttggggtgttttaagttagaggcgtttaaggcgcacgtttgctctactagctgtggctagggagggagcgtgcgccttttgctgtgcttactgggcttagtggacttttcattgcgtgcgagaggccgaaccctgctttggacgcaggaggcgatttaagagggtgagaacttcaaattaggtcctggtatggggtgggccagctgaggcgcttaaaagcgattctgagaggtttcgatcttgaggctagtggggcggatgtgattcctgtggatttactgatcaaggattcaccacaaacgtgtgggctaaccactaaatcgaacttatttttgcatcacagggtctcatgagtacaaaaatccaccacaaatggaactttacctccatcctgtggtggatattcgcacattctttcccctgcgggctattcgtgggtcagtaagcagtcaaacagggaacttccgccgcgggatccgaactaaacacccacgataaagacaaaagaggaattacgtaggggagttcttgggcacttgggctagtttcaacatctcaaaactagctcagcatttctgccacttgctgcagaccagtggtgatatcggtacctgcagtaactccagtggtgacagtgtcggcgtagaaaatcttgtcgttttcaatggcgggaacgttggctagcgctgggttggagaggaaattagcgaagttctctcggcctttaccttggaagtcctgaatgatgatgatctcaggtgccatcgcaacaacttgttctgggtctgcagtgatggtgcctaccgcgccgagagaatctaccactggagtgccgccggcttcgcggatcaggccgttgagcatggcagattctggcatgaccatttggcgtggtccgcgttgcatcaaagtgagcacagtgggggaggtggcaggcttgtcgatgtcgatgcggtttgcatcgatttctgcgattgcttctgcggctttgtcttcttcgccgacgagttcacccacaatttctaggtgtttggtgatggcgtcgatgtctccccaagcgtctgaatcgaagttaactacggggacgttgaggccttccaaaatgtcgatggtgccttgttcggtatcgaaacgcgcactgacgatcaccaaatctgggtcggcggcgacaacttgttcggggtcgaggctgccaccgtttttgacttggtattccacttgggaggccagagctgcggtttcttcgtcagcggtgtccatttcggcggtcatcacgacgcggtcggcgcctgtgatggggagaaccaaggatgctgcctctggggtgagtacggcgatgcgctctggtttggattctaaggtgatggaggaatcgtcgagtgtgacggtgcgtgggaatgcgccgtcagctgcggcaacgctggttgtaatcgaagtggtttccacagttccggaagtgccggaagagtcagaagaatcagaggtgcagccgcttaacacgagcgcactggcaacaatggcgatgagtgattttttcatgggtttttaagtcaaactttcaatcaaaagggatttggatgcgggatcacgcgaagtgagctggtttcgggatcatcgcgcaccgcaatgggcagtccgtacacggtggacagtgtggcaggttcgagcacctcgcggatgtcaccttgggagacaacttcgccgtcggccatcaacactgcatggtcgcaccaacgggcaacgtggttgagatcgtgaaggacgacgatcacggtggtgccggaattagctcgggcgcgcaggagttgaaggacttcaacttggtgccgtagatcaagggcggagacgggctcgtcgagaagcacgacggcggtgtcttgggcgagcgctcggccgatgtggatgagctgctgctggccgcccgataattcgttgacgggctgctcggcgatgtcgagcgcgttgatggcgcgcagggcgtcatcggtggcgcgtcgatctgcgtcggtctccacggcgaagcggccacgatgcgggtagcggcccatcgcgacaacgtcgcgtgcactaaaaccaatgcgcaactcggtgttttgcggcacgagtgagagcaggcgggctcgggctttagcgcttttcgacgcaaccccactcccaccaaccattacctcgccggtggattcaaccaatcctgcaatcgccgaaagggcagtacttttaccagcaccatttgggccaatcagtgcggtgacttttccagcaggtgcagaaaaagacacgtttttcactgcatggcgagaggggaattcaacgttgagatcacgaatttcaactaattgaggcatgagtttttacagccccaatccgcgtcgcttgcgcatgctgagcagtaaataaaggaaaattggtgagccaatgaacgccaccaccacgcctgtttgcaagacgatgggggagaagatcatgcgggcaacagtgtcggaaacgataacaaacgtggcgcccaaaatcgcggcggccgggagtaacgctcggtgatcggcacctaaaacaatgcgcaccaggtggggtactaccaatccaacaaacgtaatggtgccggagaccgcaacagctgtggcggtgagcagtgccgcaagtgctagcaaaatgatgcgtgcgcggttgacgttgagtccagatgtttgcgctgtggaatcacccagcagcaacaagttcagatcgcgggaaccgccgatagctagaatcaacccaacgataatggggattattgcaacgcccacatgttcccacgtccgagataccagatcgccgttgagccaaaacgtcacggatcgaagctcagaatcttgtggtgcgttcgcagtggcgctggaaataacagcacccaaaaaggcagtgatagccatgccgaccagtaccaacgtggccggatctgcgccacggccatccatcgcgcgggaactagcgatcaaatataccacagccaccgtgaccaatgcgcccacgaaggccgcaaaaggaacggtccattggccaaagaaactcgcaccggtgacaatcgccaagacagctgcaacagctgcaccggaggacacacccacaatgccgggatccgccaacgggttgtgaaacaccgtctgcatgatcgcaccggagacagccagcgccgcacccaccaatgctgcgatgataatgcgtggtgcacggatatcggtgacaacggggttggttgcaagctcattcaatggaaccgtcacgggacccagcatgagggaagcggtgaaggcgatgatcaacaagacgagggtgccgatgatgacaacaggagcggtgagctttggttttttcgaaacacctgtgcgcgacaaaacgacccttaatgaaaattgttatgacttgtttacccaagcaatactaaccaacagattgaacaaaaccctaaactttcggccgatagcaaccccgctcgactggtaaatgttgcctcaccggaaaaggtctgtccaaggtgactacactgatacagcatgacgacgcaggataaagatctcaccgcacaaaccgcttccagagtcctttctggaattcagcccaccgccgattcctatcacctgggcaattacttgggagcagtcaagcagtggattgacctgcaagattcctacgatgccttctacttcattccagatctccacgcgattaccgtcgatcaggaaccagaagagctgcgcaaccgcaccatttccggcgccgcacagctgctggccctgggcattgatccagaacgctccaccttgtttgtgcagtcgcatgttcccgcacatgcagaactgtcatgggttctgacctgcctgaccggtttcggcgaggcatcccgcatgacccagttcaaggacaagtcctccaagcgtggcgccgaccgtacctcagctggtctgttcacctacccgatgctgatggcagcagatattttgctgtaccgcccacatcttgtcccagtcggtgaagatcagcgccagcacctggagctcacccgcaccctcgcggagcgtttcaacaatcgtttcggcaaggccttcgaggttccagaaggattcatcccgcagggcgcatccaagatttacgatctgcagaaccccaccgccaagatgtccaagtccggcgacaacccgaagggcatcatcaacctgcttgatgatccaaaggtgtccaccaagcgcatcaagtccgcagtcaccgacaacgacggcgtcatcgcctacgatccagaaaacaagcctggcgtgtccaacttgctggtcatccagtctgcgctgacgggtacctccatcgattcgcttgtcgacggctaccagggcgctggctacggtgcgttgaagggtgacaccgccgacgcgcttgaggctttcaccactcctttgaaggcaaagtacgacgagtacatgaatgaccgcggcgagctcgaacgagtcttggctatcggtgctgagcgcgccaccgaagttgccaacgaaaccttggctgatgtgtacgacaagattggtttcttggcgtctcgtcgctaacaactagaccctcgattattacaatccggctacttcggaagcgtttgtggccggatttttctatcctggaaggtattaatacttctttaagggtcggaggattttcgtatgtctactagaacaacgccacaagaccgttataccgacgaatacggcatcgaacgcgtcaacaaggatgaacccggcctggtggacaaactccgggacaagcacgactggtttgatcatctcatgcgcatgaatgaacgtttcggcgcaaaaggtggcaaccaattgtcggcgggtattacgtatttctccgtgctgtcgatcttcccgattgccatgcttgtcttcggtattgcaggtgtcatccttgccggaaaccctgaagttctcacagatattcaaaatcgaatcaacgatgctttagaaggcgagatcggtaacaccgtcaacggcatcattgattccgcgattgcgcagcgtggtgctgtgttgggcattggtggtgtaactgccctgtggtctggactggggtggatggcgaacctgcgctttggagtttcccgcatgtgggccattgacccaactgaaggcaacttcattcaaaagaagctcaccgacttggtcgcgctgatcgtcttgctgctggccatgggcgtagccttcggtatcacggcgctcggtgcttccggactaaccaaaaacctgctggactttgtgggcctgggggagattccgggcattagctacatcacctgggtggtcgcagcacttgttggtgtcttggctaacttcctggtgttcatgtggctgattttctccctgccacgtaccaaagttcccatgaaaccgggtcttcaggcagcactgcttggcgcaatcggttttgaggtggtcaagcaggttggatcgctgttggcttcaaatgcattgagtaaccccgcgggtgcagcattcggtccgatcatcggcatcatggttgtgctgtatttgatctggcgcatcctcatgtattgctctgcgtgggctgccaccagtgaagaagcgttgcgtcttgcgactgttccagcaccagagcctgcgatcattcgggttcgccatgaaattgatccaggtgaagaagtctcccaatctgctcgaaaagtgggcattggagtggccgtgggtgccgcgactgcgggtgcttttgcgctgttgcgtaaaaaatagtttttattaagggcattccctgattcccaggtggtgccacattgtttatggtggagatatgaacacgaacttgccgaacctatacaccgcatttgaccttgatcgaagtgaatcctccgaagctttaggtgtttccctttctgcccgcgatcttcgcttagaacaaatgggaattgcccaggacgatcctcgacgtgcccaaaccgtccaagctttcgcagtgcttgcagacccagcaaaacgcgccacctacgatgctcaattagaagctggagttccactcacctgggcgcagattcagcatttaggaaacttcggcaccttgccttccacccctactgcgcagccgtttgcggcacctcagccggagccgtcgccggaaccgcaacagcagtggaatagcggacaaaactatgcgtatggcaatccgaccatggattaccaaactcagcagagctacaacccgatgcaggaccaaacccaagcgtcgatgtatgcgcaacctttcgcgaacacccctgcaccgatgtacaacagcaatcaggtttttaacaggcctactgcgggtacgcgtttgtggatggcgatcctcgacagtatttttgccggcatcgctggtggaattgtctccggtattttcggctttggatctgaattcctcaccagtgtcatcatgattttggtgctgatcgtctatatcgtgggtagtgaatccttcctgggatccacccctgcgaagaagataatgggctacgagacccgtgatgtggacactcactccaagctttccgctggtgccgcagcaaagcgcaactggtggaaactgatcagcttcaccggtatcggttctgtggtgtcgtttgtgatggccatcgtttatggctcttccattaatgaaagcaatcagatgcgcggtatgcacgaccgcttggccaacgcagaggtcgtgaagaagaacacctagttctttttcttgggagatctgaatgtccacgctagtgcggcgattagcaacagcacgatgattccgatgggcaccacgagcttaagcagcgtgttctgcgacccaccctcacctgaagtcaggttgtcggtgggttctggtaattctggggtcgccggtgccacatcgttcgcgctgccggagcccagctggcccacgccggaccccggcgtgatggggagggaggcgtcgataagcaatcgtgcttgttcccacggacgaatgtcgctgacggtggaatccaagagtacggcggcgaggcggcgaccaccccgatcgagaccgccgacaaaggtgtggttcgcgtcgtcggtgtagccggtcttgccgccgatgccatcaggatcgttcatgaacaaggcgttatcgttccagacttggaaaccctcattgtcgccccaaccagggaaatcaatgtgatcggtggagataatcgactcgaaaaccgggttctgccacgcatgctgataaatcaatgacatgtcgtatgcggaggtcgacattcccggcgcatccaaaccggaataagtggcaacgaaggtgtcttgagtgcccaactccttggccagcgcgtttactttctccagggttgcttgatccccaccaagttcctgagccaacagatacgccgcatcgttaccgctggctaaaagaagaccgtgcagcagctgatcaacggtatactggccgccctcgccgacacccacgcgggagccctcgatgttggcggcttccatcgtgcccgtgaccacggtggtggggttcagctcatcgatggcaaccaagctgagtaacaccttgatgatcgatgcggggcgataccttccgtggggatcctttgctgcgatgatctcaccggaatcaatatcaaacaccatccacgccgacgcagtgatagtttcatcagaatcttcaggaagctcaaagccattgggagtgatcacaccgcatgtcgccaatttctcaccacctgcgggaacagatggaaccggaaccagcgcgggcgtttgtgcacccggcgcgactacctctgatgtgctgcgcgccggggaaggagattccttgtaggggcacagatcagtgttgggagcttccaaccgggtggtgggggtaagcgcgtcgtcgatgatgtcttcgagagtttctgcgttgtcggctgtcacttcggggacgttgtcgatcggttcctgtgctaccgcaacagtgggtaaaagtagcgcccacgttgtcagaagtgctgtgaatccgtgtcgaagtgatctcctcatgggttggacatattaccttttcttgcgtgctcgacgagggaccggtggtgtttaggcgtgtctgtgtgcctgtgatgtcgtggccggctgggcggctatttaagaggtcgagattcctagatgaatgcttgtgtggtttagtgcgttaaaaggccttagagacgaatctggagcctctgtttttgggcgatgctggacagaaaaaggatggtttccagtgcgaccaaacaagagtgcccacgagagcctcgaaaccaaactttgggcatctgtgaccggtattgaggccgcaaaaccacacaggtgtgcccacggaccgggaaaagctgatccgtgggcactcctgtttggtgcggtggggacgaaccccaaataggcgacctagaacttgctgaatcgcttgatcagcatctcctccagctcgcgccagctctcagagtggtcgttgaatggtgcgtgagggacatatccggaggtgtcgctgccgccgagcatgtaggagatgtagtcctgcatgcgtgggttggccaggaagtaggaattcatggagtcgtcgtcggcccagtcggcggtgtctgccatgagttcgtaggcgcgggccatttgttgggtgtctacggcgtcgacggaggtgttgatgtctttgaccaggccgttgaaggagtagacgttgtcgctgtggacgaggagttcggtttcaccggcgttgatgccgagcatgaggtcgctccaggtggaggcgcgggcgaggtcgtggtcatcgtgttcgacgagccagcgcaggagggatttttggctgttgaaggtgaagatttcgccgaattttccgaggaatactggctgtccgccgaggtaggtgcgcagggtgtagatggtgcgtccgtcgatggagaccttgatggggtcgatgcctgctgcagcccatggggagttgtcgtaagggtcgaccttttcggcttcttccttggcgatttgctcttcagcctcgcgagctgcctgaacagctgcttgtgcttcttgaatgcgggttgcggcgtcttcggtaaagaggctgtttacttccttgacggtgatggcttcgtcgagggcgtcgacaacgccgttccagttggtggctactgcgcgaccaacggaggtccattcgcccaggccgttgggtccggagtagtgctcggatccgcggtcaacgttgctgagcacggagtgggaggagaagaacacggtgactggggaggcagcggtgacgtggccgaggctgcgcatgacagcgaagatgcgggagagggttttgacgtttgcgtaggaggggcgatcggcaagaagtgctggtgcgccgatgatgtcgagctctgcgttggcgtctgggacaacgcgggctgcgtcgccggagttgaatttcttccactctgggtgggaggtcagatcatgcttgtcgtcggattctaagaagacgaggagctcttccggggagttgaatacataaaggtcatcgttcgcaccgagaaacgcttgccattcattgccgccttcgcgccagtttggtgcccacagggtatagaagtcaccttctgtgagggagagtttaacgggaacgattcctttttcagccatgctgataaatcctagccggtagtggttttcttcgtcacgtatgaggtagggcctttaaggattttcttagcctgtgggtcggaagtagccgtgaaaagccatcccgatgttggaggttcggatgggattgagctgcacggggtcgccggcttcgatgatttgcccaccgccggcgtacatggctacgtggccgtcccaaatcagtagatcgccttcttgaagttcgtcgtaggtgacttgccggccgactgcttgctggtccgcgatgcgcggaatttccaccccggcgcgacgccaagcccactgtgttaaaccgctgcagtcgaagccggaagtgctggtcccgccccataaatagggtgtgccgagggcttctttcgccgcggctactgcttgtttgcccacctcgttgtcattgcttggcgcctgcgccgccatatagaccggcgcagtttccgcgacgggttcggcggtgggctcaggtgtgaggtcctgaatctgcactagcttttcgacgattggttgcacctgtcgggacatctcttctagccgttgactggcttcggcaatcatcagtccaggaagtgaaattaattcggtgcgcgctgcgaaagattccgccggattcatggagaaactgcgcatgactaatcccgctgcctggttgaggtagtgctgcgcggtggtggcgatgtcgtggcgggctgcgtcaatgaggggagcggcctggatgagggaggtgacaaggaggtggtgttgttgtgacgtggcgtcgaaaagcgataaaagggtggtggggttggcgctgagctcgcgcccgagcgcgatggcggctgaaatgtcaggcgcctgcgggatggccagttgcggaagttgtgctggttcgtgtgtggctaggcggctaagggcgctgatcagaccgatcatgtcaggcgctccaatgcgtgtgcgagttggtcgtcggtgtcttcgatttcagcgaggcccgtcagcgcgcggtttcctaaattctcggcggtgtgggacagcaaggtgaggttgcgggcataggtggcaagggaggcggatagtgcctggtggatatcaaactgcgcgccagaatcagtgggaagcgcgggcacagcaggggtgggcaacaaacacagctcgtgggcgagctctttggcgtggggcaaattaatcctcatactttgttggactggaaaagtggccgtttggttccctccaagcccaaattcgcccgcgcggtcttcttctgggcggcaatgatttaacatgtgaagctatggacatcaccatcgtcaaccacccactcgttgctagccgcctaaccctgttgcgcgacgagcgcagcgacaacgcagctttccgtgcagcagccaacgacctcggcgccatgctgatctacgaagcatcccgagatctggaagtcgaacacttcgacaccaaaacccccgttgccatggctgaaggtactcgcctgaagcagccacccatcatcgttcccatcatccgtgcaggtctcggcatgatcgacccagcgctgtcgatgattccggatgcacaggtcggcttcattggccttgcccgcgatgaggaaacccatgagccagtcccataccttgaggcgctgccacaggatctaagcaaccagcctgtattccttgtcgatcccatgctggccaccggcggttccctcctgcacgcgatccgccttcttgctgatcgtggcgccaccgacatcaccgccatctgcatggtttctgcgcagccaggtgtggacgcattggcggaatctggtcttccagttcgtttggttaccgccaccatcgacccaggtctagacgaaaacgcctacatcgtgcctggtcttggagatgccggtgatcgtctctacggtccgcgaaacatcgacctttaaaagtttctaagggcattacggaaaattcttgcccactgtagtgggcggtgagtattcttatgcatcggcaatgttgtctatgtgtcgaaggaaatgtcggaaaagcggtggtcaagctatggccacgctttcgcgagccgactgaaaaaacttcgaaccctccgtggcttcagccaagaagagctcgcagatctctccggagtgtcccgaaacaccatttctaattacgagcgcaacgaaaacaacaagggcaacgccgtcgatccgcagctgtccaacatctacaggttggcccaagccctcgatgtgccgcccatcgcgctcatgcccgccggctccgtgcccgtggcaaaaatctgcgtcgacgaaaccgccgccattgacgtgcggtggccttcagaaaaagatccactgcttttcgacgcagacctccggctcacccgcaaccgcgagcagccaggaaactaaagcttgctcaaccagctttggacttcatcctccagctgatgcaacaactgagctgcttcatcatgggagctggcctgaccaacttccaaatagagcttggctttcgcctcagttccagagactcgaccaatagcacggatatgcacatgccccacctggccatgcaaagcaatgccctgtttttcaggaagaatatgtggggtgacagacactccaatgagttcttgctgaggatgcgcaatccagtgatcaactaactcgcgtggactgctcgtgcgcacagcaatttgcgaggacgcaaaatacccatatcggcgatacaactcattgagtttttgctgcaggcttgcgccctgagccttcagttcggcagcccacgacgccatgaacaacgctgtagagatgccgtccttatccggcacgacatctggaaccgggcaggtgcccacagcttcctcataagcgaaagcaagcggtccgtcgagaccatcggcagccctcgacagatttttgaatcccgtcagtgtctcggaataatcccaccctttatcctcggcgatgatacccagaagctgcgaagacaccaccgtggtggcaaccacgggacgtgggccttcaccggaatactccggaaccaaacgagtagccaaaagtgtgcccacctcatcgccagagagcattcggtggccgccatcagcggtacgaatacccacagcacaacgatcggcatcaggatcaagcgcaaacaaaatgtcagcgttcttttcctttgcgcgttccaacaacaactcaatcgcagaaggctcttccggattggggaacgccacagtggggaaggtgggatcaggatactgctgagccttcacgccatgagtatggggaaaaccagcaaattggaaagcattggccatcgcgcggccacccacaccatgcagagcggtatacaccacgcgaagattgccccgctcagaattcacccgcaacaaatcagcctgatcaggagtcaccaacgacaccatctcatcaacatatcgacgcagctgatcagcagtggggcgcaccgtcacccgaggaacccgaatcggatcttccacagcattgatatgcgcctcaagctcaggctccagttcagaataaagctggcgaccattagacaaaaacaccttgtagccattgtccgccgcaccattatgcgaagccgtgatctgaacgcccgcatccaacccatgcttgttcaccaaccacggaatcaacggcgtagggctaggcgtggggagcaacgtcacctcaaaaccagcacccgcgaacacctccgcagtggttgcagcaaaagtatgcgaaccatagcgagcgtcataccccacaacgacccgcaacggaccatcttggggatacaacgccctgccgattcctgtttcatcctcaggaaccaaatgcggcactggatttagtgccgcacgttctgccaaccaactagcaacacctgctgtagttctggttacctgcaaaacattcatctgatggcgcgccgggccaactggtgcacgcaaccctgctgtgccgaaactaagctgacgagactcgtccatgaacaccccgatcctttgttttcgtgggatcactattagactcgactctaccgcgctgcaggttttcctgatacgcctgcggacaaaacagaaaggtatttcacgtgatggaaattggtgtgcaggttgcctcatggatggaccgccaccatgacgaggtcataaagtggcgcaggcatttgcacagccatcctgagctctcccacatggaataccgcacgactgagtatttggcctcggttctgaaagatcacggcatggaaccacacctgttcccaggaaccggtttgatggtggatatcggaccagaaggggactcccgcctggcgtttcgcgctgatatcgatgcccttccgctgcttgaatcaaccggcttagagttctcttccacagccactggcgttgcgcatgcctgcggacatgacgtgcacacggtgatcgctttggcacttgcctgtgcactgaacaccatcgaactgcccatcggcattcgggtgattttccagccggcagaagaagtcatgactggtggcgcaacggacgtcattgcccacggtggccttgatggtgtggatgcgatttacgccatccacgttgaacccaaattgaaggtcggtcgcgtcggtgtacgcgctggcgcgattacttctgcctcagatgtgatcgaaatcagagtcaagggtgaaggaggacatagcgcacgtccacacctctccgctgatgttgtttacgccttgagcaaattggtcgttgatcttcccggtttgctgtccaggcgcgtcgatccacgcaccggcaccgtgcttgttttcggcaccatcaacgccggctatgcgcccaacgcgatcccagattccggcatcgtgtcaggcaccttgcgtacagccgacatctctacctggcgtgacatgcgtccgcttatctctgagctggtggaacaggtgctcgcacccaccggagtcacccatgaactgatctacaatccgggtgttccaccagtgcttaacgacgatgtcgccaccgctttgttggcaagcgcagcacgcgacatggacacacaatctgttgtccaagcgccgcagtcatccggtggagaagacttctcgtggtaccttgaacacgtcccaggatcaatggcccggttgggttgctggccggggcacggacccaagcaagacctccatcaaagtgacctggttgtggatgagcgagccatcggagttggcgtcaggctctttggctcccttgtgcagcagtacagtagccgatctgaagctttcttaaattcctaatgggggtagtgtgtagggctggctctaaattgctgacacgtcacccaggctaattcagcagtaatcatttagacttggaaccgcttaccagtggtttcaacaatgcattcacccagctcacacgtgtggaggtgccttaatggcaaagaggatcgtaattatcggcggtggacctgcaggctatgaagccgcactcgcaggcgctaaatacggtgcagaagttaccgttattgaagatgtcggagttggcggatccgcagtcaccatggactgtgtaccttcaaagtccttcatcgctggtaccggtatcaaaaccgacctccgacgtgctgatgacatgggacttaaccgtgggcttggaaaagcacacctagaaatcgatgcactgaacatccgtgtgaaggaccttgcgaaagcacagtccgaagatatcttgggccagctgcagcgctcagatgtccgcatgattaacggtgtgggccgctttgatgattacaacaccaagcaaaccacccactacattaaagtcacccacagcgatggctccgaagaaaccgttgagtgcgatctggtgctggttgcaactggtgcaaccccccgcattcttaaaggtgcagagccagacggcgagcgcatcttgacctggcgtcaggtctacgacattgaagaactccccacccaccttatcgtggttggttccggtgtgaccggtgcggaatttgtctctgcgtttgctgaactcggcgtcaaagtcaccatggtggcatcccgtgaccgcattttgcctcacgatgacgcagatgccgcagacgtgctggaaaccgttctggctgagcgcggagtatccctggaaaagcatgcccgcgtggagtctgtcacccgcaccgaagacggtggcgtgtgtgttcgcactgctgacggacgagaaatctacggttctcacgcgttgatgactgttggttccattccaaacacggcagatcttggcctggagaacatcggtgttgagctggcaccatccggccatatcaaggttgaccgcgtctcccgcaccaacatccccggtgtgtacgcagcaggtgactgtactgacctattcccactggcgtccgttgcagcgatgcagggccgtatcgccatgtatcacgcactcggtgaaggcgtgagccccatccgtttgaagactgttgccaccgcagtgtttacccgcccagagatcgcagcagtaggtatcacccatgcacaagttgattccggcgaagtgtctgctcgcgtgattgtgcttcctttggctactaacccacgcgccaagatgcgttccctgcgccacggttttgtgaagctgttctgccgccgtaactctggcctgatcatcggtggtgtcgtggtggcaccgaccgcgtctgagctgatcctaccgatcgctgtggcagtgaccaaccgtctgacagttgctgatctggctgataccttcgcggtgtacccatcattgtcaggttcgattactgaagcagcacgtcagctggttcaacatgatgatctaggctaatttttctgagtcttagattttgagaaaacccaggattgctttgtgcactcctgggttttcactttgttaagcagttttggggaaaagtgcaaagtttgcaaagtttagaaatattttaagaggtaagatgtctgcaggtggaagcgtttaaatgcgttaaacttggccaaatgtggcaacctttgcaaggtgaaaaactggggcggggttagatcctggggggtttatttcattcactttggcttgaagtcgtgcaggtcaggggagtgttgcccgaaaacattgagaggaaaacaaaaaccgatgtttgattgggggaatcgggggttacgatactaggacgcagtgactgctatcacccttggcggtctcttgttgaaaggaataattactctagtgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtaccgaaggctcaccagtcaaggcgtacctggacatcgatgaaattatcggtgcagctaaaaaagttaaagcagatgccatttacccgggatacggcttcctgtctgaaaatgcccagcttgcccgcgagtgtgcggaaaacggcattacttttattggcccaaccccagaggttcttgatctcaccggtgataagtctcgcgcggtaaccgccgcgaagaaggctggtctgccagttttggcggaatccaccccgagcaaaaacatcgatgagatcgttaaaagcgctgaaggccagacttaccccatctttgtgaaggcagttgccggtggtggcggacgcggtatgcgttttgttgcttcacctgatgagcttcgcaaattagcaacagaagcatctcgtgaagctgaagcggctttcggcgatggcgcggtatatgtcgaacgtgctgtgattaaccctcagcatattgaagtgcagatccttggcgatcacactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggattcattgccgatcacccgcacctccttcaggctccacctgctgatgatgagcagggacgcatcctggattacttggcagatgtcaccgtgaacaagcctcatggtgtgcgtccaaaggatgttgcagctcctatcgataagctgcctaacatcaaggatctgccactgccacgcggttcccgtgaccgcctgaagcagcttggcccagccgcgtttgctcgtgatctccgtgagcaggacgcactggcagttactgataccaccttccgcgatgcacaccagtctttgcttgcgacccgagtccgctcattcgcactgaagcctgcggcagaggccgtcgcaaagctgactcctgagcttttgtccgtggaggcctggggcggcgcgacctacgatgtggcgatgcgtttcctctttgaggatccgtgggacaggctcgacgagctgcgcgaggcgatgccgaatgtaaacattcagatgctgcttcgcggccgcaacaccgtgggatacaccccgtacccagactccgtctgccgcgcgtttgttaaggaagctgccagctccggcgtggacatcttccgcatcttcgacgcgcttaacgacgtctcccagatgcgtccagcaatcgacgcagtcctggagaccaacaccgcggtagccgaggtggctatggcttattctggtgatctctctgatccaaatgaaaagctctacaccctggattactacctaaagatggcagaggagatcgtcaagtctggcgctcacatcttggccattaaggatatggctggtctgcttcgcccagctgcggtaaccaagctggtcaccgcactgcgccgtgaattcgatctgccagtgcacgtgcacacccacgacactgcgggtggccagctggcaacctactttgctgcagctcaagctggtgcagatgctgttgacggtgcttccgcaccactgtctggcaccacctcccagccatccctgtctgccattgttgctgcattcgcgcacacccgtcgcgataccggtttgagcctcgaggctgtttctgacctcgagccgtactgggaagcagtgcgcggactgtacctgccatttgagtctggaaccccaggcccaaccggtcgcgtctaccgccacgaaatcccaggcggacagttgtccaacctgcgtgcacaggccaccgcactgggccttgcggatcgtttcgaactcatcgaagacaactacgcagccgttaatgagatgctgggacgcccaaccaaggtcaccccatcctccaaggttgttggcgacctcgcactccacctcgttggtgcgggtgtggatccagcagactttgctgccgatccacaaaagtacgacatcccagactctgtcatcgcgttcctgcgcggcgagcttggtaaccctccaggtggctggccagagccactgcgcacccgcgcactggaaggccgctccgaaggcaaggcacctctgacggaagttcctgaggaagagcaggcgcacctcgacgctgatgattccaaggaacgtcgcaatagcctcaaccgcctgctgttcccgaagccaaccgaagagttcctcgagcaccgtcgccgcttcggcaacacctctgcgctggatgatcgtgaattcttctacggcctggtcgaaggccgcgagactttgatccgcctgccagatgtgcgcaccccactgcttgttcgcctggatgcgatctctgagccagacgataagggtatgcgcaatgttgtggccaacgtcaacggccagatccgcccaatgcgtgtgcgtgaccgctccgttgagtctgtcaccgcaaccgcagaaaaggcagattcctccaacaagggccatgttgctgcaccattcgctggtgttgtcaccgtgactgttgctgaaggtgatgaggtcaaggctggagatgcagtcgcaatcatcgaggctatgaagatggaagcaacaatcactgcttctgttgacggcaaaatcgatcgcgttgtggttcctgctgcaacgaaggtggaaggtggcgacttgatcgtcgtcgtttcctaaacctttctgtaaaaagccccgcgtcttcctcatggaggaggcggggctttttgggccaagatgggagatgggtgagttggatttggtctgattcgacacttttaagggcagagatttgaagatggagaccaaggctcaaagggaatccatgccgtcttggtttaatactgcacccgtctaatgaaaatcattactattaggtgtcatgatggaccatgcacacgattcctgctcaccaactctgcgccgtgatttggaggtcactggccagctccaacctgagaaagctgtcgatttagcagcgccgcacgaagggaaggttgccaatataacgaaggtgacctcctcaaatatggagcacaccatcacgcaggcctcaaaagctaaggaggtggtggtgctcattggtcactccctgctgcccacatttcaggatttggaaaaagacattctgcactttcaggcaggtaataaagggcgattttctgtagcgattgttgatcctgatcgcagtgcagatgtggttgccagatttaggccaaaacagattccggtggcatacgtggtgaaagatggcgccagcattgcggagttcaactcgctcaacaaggagccggttgcacaatggcttgatcattttgtgtcgcgggaaacgatccccaatgaaaaagagggggacgtcgataagcaaatagacccgcgcctgtggcgggcagcggaattggtgaacgccggtgattttcgcgcggcgttggcgttgtatgagcagttgccgcaggatgcgacggtgaagcgggcgcacgcggcggtgtcggtattggcgcggatgtctgtggcggatcggggagaggatccgatcgagaagtcgcgccgggatccagacgatgtgaacaaggcgctggcggcggcggatatgtatgtgttgatgaatcagccggacacagcgctcgcgcaccttgcagcactattgccaaaaccggaggctgcccggcggatcgtggagttgctgaacttgtttgatccgctggacctggtcgcattggaaatcagggcgcaggtggggaatgcaatgagctaagaaaacactttaaatattctaagaaacagttcaagttttgctgtagtttagatatgacaaggcaatgacacaaggagacaaatgaagaaggccatgagagctgcgatcgggctcgctgtttccaccgccatgacatttgggatagctccgagcgcacacgcttttaccgcactgtcgagcaacatttttgccccaccagctcgcaatactgaaaatgcgaacggcgatgtgagtcaggttgaattagaagtatttgcgctcgttaaccagcatcgaattgcccatggtgtagcaccgttggcgatgaatgagtctcttaattccggctctaagagctggtcttatacaatgtcgcgaaccggaaattttgttcattctagtggcggaaactatggcgagaatatttactgggctagcaatatccgcccagcttcgctcatttttgaaagctggaagaactcacctgggcataaccggaatatgctagacacgcgctactcccagattggtgtcggagttgtctatgatagttctggccaaacgtgggcgacaactcagttttatttttagtgcaaaaagggcttcgaaaagtagtatgaccagtgctttttgcggatatggtcgatgattgaaggacattttataggctgtcgattcggcccgttgcccaaatttctaagcaaggcaacggaaggaatcgaatgcgtctgagcttgaggaagagccccggaaattccttcggggtcactgcctttacgctgcctttacgagcgaagtcactgtggaattcacggacttgaggaactcacaaaaccagtgccgccacttccgcatcggtaagcgtcgcgccttgtagcagtgcgagcaaggtggggccgtcgatgtggatgccgatcaggaccaattcagtgccgggggtgatctctgaattggcccaataggcggccgggcgaatgctcaaattggggccggcttggtgccagacctggacgatgttgaggtgatcagcgatccagcaatagcctttggagcgaacgagtccagtggtggaacgcagtacctgaagtaggcgatccttgttgaacggccggtcagagcggaataccacggaactgatgccgtattcctcggtttcgggagtgtgcgggttttcgagttcttccgtgtagccctcgtaggcgcgggcggtggcttcgtcgtagaggaaagctccgaggatgtcgtcggtgatgggggagccgtcattgaggccatcgatgagtaagtcaatgcgggcgcgtggactcatgctggcgattagtgcgcgggtttgctcgaggacagtgcggtccaccaggtcggatttggtgatgtagatgcggtcggcgaactcgatttgatcggtgagtaggtcggcgatggtgcgttcatcgtcctcggttgcgcccatgtcagcctcggtgagggaggtgtttttgcggatgaggtcgatgaattgggtggcatcgaccagggtgaccatggtgtcgatcggtgctttgtcagccaggcgggtgccgtcatcccactgccattcaaatgtggcggctaccggcattggttcggagatacccgtggattcgatgacgatgtggtcgaagcggtcgctgctggcgagttcgccgacggaatccacgaggtcttcgcgcagggtgcagcagatgcatccgttggtcagttccacgaagcggtcttcgccgcgggtgaggtggccttcggatgcgatgagggctgcgtcgatgttgatttctgaaaaatcgttgacaatgactgcgattttccgggatcctcggtggtggaggatctggttgagcaatgtggtttttccggagccgagaaatcctgatagcacggtgactggggtcgttgtggccatgtgaaagccctccttttgggaatcattttcaatagagtcgacgcaagtgtacacttcttaatggaaattgttttcaataaagtcaagttttttgaccttcgctttttaggagcaccccatgtcatctcatgatctcgttgacgtagttgtcgtcggcgccggcgctgcaggtctcgccgccgctgtcgcgctcggccgctcactgcgcagtgtcatcgtcatcgacgctggtcaaccccgtaacagctatgcgcacgctgctcacaatgtcctcggccaggaaggcattgcgcccgccgagctgctggaaaaaggccgcgccgaagcgcgttcctatggcgtcaccattgcgcccgggcgcgtagcaaaagttgagcgcaccggttccaccttcgccataacgcttgacgacgcctccctccttcactctcggcgcatcattttggcccacggcgccgttgacgatctgccagaggtagaaggactgtcagatttttggggaaccaaagtgttgcactgcgcttactgccacggctttgaggcccgcgattctgaaatcgtcgtggtgggtacctcgcccatggctgcgcaccaagcgttgatgttctcgcagttgtccaaaactgtcagcttggtgggcacgatcgacattgatgaacaaaccagcgagagcctagatagtgctggagtaaaagtgttgggcaccaatgcggtgcgcgtatccgccgaaggtgatggcctgtctgtggaactgtccgaaggcgatcatttaagctgcgacaacatcgtggtggcatctcgtccactggtggatggcacgctgtacacccaacttggtggtcagatggaagaaaacccgatgggcaggttcattccaggtacccaaaccgggcgcactcctattgaaggtgtgtgggctgccggaaacgcgcaagctcccatggcgatggtctatggttccgctgctcaaggcgtgatggctggagcagagatcaactttgatctgatcctggaagatatttccgtggcaagcgcgcagagctaaactgcgtgaggttgtggcctgtcacacataatcggcctagggtgggactttaaggaaacagtgcacaaataaatctcaaggagccccatgcgcatccacgatgtttatacccacctttcggccgataactttcccaaagcagagcaccttgcgtggaaattctccgagcttgccaccgaccccgtggaggtgacaccggatgtttcggagatgatcatcaaccggatcatcgacaacgcggcggtgtctgccgcgtcggtgttgcgccggcctgtgactgtggccaggcaacaagcgcagtcccatccgcgggaaaagggcggaaaagtttttggaatttcaggcagctactcaccagagtgggctgcctttgctaatggtgtggccgtacgtgaattggacttccacgatacatttttagcagctgaatactcccatcccggcgacaatattccaccacttcttgcagtagcgcaggctcagagaagcagcggcagggatctcattcggggtatcgccactgcctatgaggtgcaggtggaattggtgagggggatctgcttgcatgagcacaaaattgatcacgtagcccaccttggtcccagcgctgcagcgggtttgggcacgttgttgcatgtagatgaggaaaccatctaccaggcgatcggccaggcattgcacaccacgacggctacgaggcagtcgcgaaaaggtgagatttccagctggaaggcgttcgcgccagcgtttgcgggaaagatggccattgaggcgatggatcgtgcgatgcgtggggagggttcgcccgcaccgatttgggagggcgaagacggggtcatcgcgtggctgttatcgggcaaagatcatgtttatcatgtgccattgccggaacacggcgagcccaagctggggattctagagacttacacaaaggaacattcagcggaatatcaatcgcaggcaccgattgatctggcgcgcaggatgaagccactggttgacgcggctggcggaacggaacacattgcagagattgtgctgcgcaccagtcaccacacgcattatgtgattggcactggggcgaacgatccgcagaagatggatccgcaggcctcgcgtgaaaccctggatcattccatcatgtacattttcgccgtcgcgcttcaagatggcgtgtggcaccacgagttttcctacacccgcaagcgttccacccgcccggaaactgtggagctgtggcacaagattcgcaccgtggaggatcctgaatggacgcgccgataccattctgatgatcctgcaaaaaaggcctttggtgcgaaagcagtgatcacaatggctgatggcaccgtgattgaggatgaattggctgtcgcggatgcccacccgctgggtgctcggccgtttgcgcgggagaattacattgaaaaattccgcacactcgcgcaggggattgtcattgattcagaacaggaacgcttcttgcatgccgtgcaaagcctgcctgacctggatgatcttgatcagctcaacatcgaagtcgacataagcaaccaggccgcgacgaaagcggggctgttatgaatctcttttcgaatggtgttgatgtggggaggcgtcgacaagcatttaaagcggcactcgccgcaccccacatcgcccggctgcccggcgcattctcccctctgattgcgcgctccatcgaagaagccggcttcgaaggcgtctacgtttccggcgccgtcatagctgctgacctggcactacccgatatcggcttgacgacgctgaccgaagtcgcccaccgcgcgcggcaaattgcgcgcgtcacagacctaggagtgcttgtcgacgccgacaccggctttggcgaacccatgtcggccgcacgcaccgtcgccgaattggaggacgccggtgtggccggatgccaccttgaagaccaagtcaaccccaaacgttgcgggcacttggacggcaaagaagtcgtgcgcacagacgtgatggttcgacgcatcgcagccgccgtctcggcccggcgcgacccgaactttgtcatctgcgcccgcaccgacgccgctggagtggaaggaatcgacgccgccattgagcgcgcgaaagcctacttagatgcgggcgccgacatgattttcaccgaagccctccacagcgaagccgacttccgatacttccggcacgccatccctgatgccttgttgctggcgaatatgaccgaatttggcaaaacgacgctgctgtcagccgacgtgttggaagagattggctacaacgccgtgatctaccccgtgaccacgctgcgtattgccatgggacaagtagaacaagcactagccgaaatcaaagaacacggtacccaagaaggatggctggaccgcatgcaacaccgcagcagattatatgagctcctgcgatacgaagactacaacgtctttgaccagcacattttcacctacagaaaaggagaaaacaatgagtgacagccaagtccgcaaaggactcaacggcgtcatctctgactacacaagcatttccaaagtgatgccagagagcaactcgctgacttaccgtggctacgccgtggaggatttggtggaaaactgcagctttgaagaagtgatctacctcctgtggtttggggagctgcccaccactgaacaactccggaccttcaacacgacaggtcgaagctaccgctcactcgacgccggactgatttccctcatccactccttacccaacacctgccaccccatggacgtgctgcgcaccgcagtgtcctacatgggtacctttgatcccgatccgtttacccgcgatgccgatcatatccgaagcattggacacaacctgcttgcgcagcttcccatggtggttgccatggatatccgcaggcgaagtggggaagagatcatcgcacctgaccacaacaaaggtatcgcttcgaatttcttatccatggtgtttggcaatgatgatggttctgtagccaactccgcagatgacatccgcgattttgaacgctccctcatcctctacgccgagcactccttcaacgcctccacattctcagcccgcgtgatctcatcaacgcgatccgatacgtattcggcgatcacaggtgcgatcggtgctctcaaaggcccactgcacggaggtgccaatgagtttgtcatgcacaccatgctggatatcgacgatcccaacaatgctgccgactggatgggcaaggcgttggatcgtaaagaacgcatcatgggattcgggcaccgcgtgtacaaaaacggcgactccagggtcccctccatggagaaatccatgcgctcccttgctgctcgtcaccgtggtcaaaaatgggtgcacatgtatgagtcgatgcaagaagtcatggaggctcgcactggcattaaacccaacctcgacttcccggccggccctgcctattacatgctgggattccccgtcgacttcttcacaccactgtttgtgctggcccgagtgtcagggtggacggcacacatcgtggagcaatttgaaaacaatgcgctgatccgaccattgtctgcctacaacggagtggaagaaagggaggtggtgcccatttcggagagaacctaatcagtgaggctgatttctaaatagccttgtgcccatctggtgatggtgtcgcggccctccgccacagcatcgccgatggttttcggagcgagcactggatcattgggcaattgggtggcgggatcacctgcgggcacgacctcgagtgtgcgctgcttgggatcaaggcgtgccagtgccagtagttcaacactggtctgctcgcagatagcccaggtgtattcggtgtcctcgtgccaggctgtggtggcgtccgcgatgaactgtgctgcatcggcaaggatcagtgagagcgccgggacatcatcaatccgattatctgaggtgagcttgcgggcgtagaaacgaccgccgtttagttccatgggttccatagtgttttttaagtgctgcctttttagttgaggagttggacaggggctgggcggatagattcttgacccgatggtgggaatgcacgctgcacacagttctcccgaggacagatccgacaaccagggccgatctctgcggcggactcgggatccaaattaaggccttgggaatacaccaagcctggtgcctcgctgatatcgcagcccaggccgatggcgaattccgcagcaggatacccgaaaccatgagttcgacctttcaccgcgcgtgcgagccacaaataggtccggccatccggcatgcgagcaacctggcgggtgatgtttccctgacgttcaaaagcacgatgcagcgcccacaaaggacaagtgccgtctgttcgcgagaagtggaacgtagctgcagattgccgcttggagatatttcctgcacgatccgagcgcacaaagaaaaacggcacccctgacgcccccgaacgctgcagagtagacaggcggtggcatgcagactcgaaagacactccaaacgcctcagagatcaactcgatgtcatagtgcttatcctgggcgaattccaaaaagcgggtgtacggcatgacaacagcagccgcgaaatattgggagagacccaccttagccaggcggatagctgcctcagaagggagatccggttgatctgtggtcagggtatccaagagctctgcatgagcaagaaacgtcaattcctccgccaactggaaacactgctgcgcctcgctgagatcttgccgcagcagaatctgacgcgattggggatcaaagtgcctccggccagtaatatccggcgcccggaaacgcaccgtgatgttgtactccgcatcaagcaactgcgcgagcctagtaacccgaagtcccggctgaccaatggcagttgccaactcctctccaaggcgatcgagcgaatcaatgtagtttttgtgggtggcaaaataatcccgaacaaaatcatgcgcagaactatgcgtgggatcaacctcagcaggctggataatatgctgcgctaactgagggaaacgatccgcgaaatctaaaagatcatccatcgacatcgtcggaccctgattcatcgccaaggtttcagccagtcgggtagcagtggccgtaccccggtcaggggagaagtaactggcctcaacatcgaacactttcatcagctgcagaagcaccgtggcagtgagtggccgtccgtcattttccaactggttgagatagctggtggagagatcaagcttgtcggccaatgctgattgggtgagctgatgggttcggcgcagtgcattgatccttgcccccgcgtaaagcttcgacatcctttgacaacctcccgaaaagcttatgacctcatgatttaactagatttacaaaaaccttcaaatccacacgacacaattacacaaattttaccttgtgcattgaaagccgtcagccgattagcgttaaagaaaataaaaaaccacaaggggagcacaccatgaaagacaccaccgagatcaactggcaaggctacgccgatggaaccgcaatccgcgaagcagtcatccactccattgaacgagaagtatcagcgggcgagcagccaaccccaaacgatcttaaatttctcgggctgttccagcaccgcgccgggtatgtgggctcgttgatcaccggttaagtgtggggagcaggctggctaaataacaatcaacgcagcgaaccgtgaaagcccacaatgcggtgtacattcgacaacaagatttcctgattttgaccacctttttaccgaaatcttgttgtcgaatgtacaacaggggcagagtgtattcacaaatagtaaaaccgggccacatctgaacatcagatgcgacccggtttttgactaacaggaatccaagaacttacttgatctcgaggagaacaacgcccttgttgacaccctcgcctgcagcgacagtaaggccggttacggttccggacttatgagccttcacagggttttccatcttcatagcctcgaggacaacaacggtgtcgccttcgttgacttcagcgccttcttcgacgttgaccttgatgacagtgccctgcattggagctgccactgcatcgccggatacgccagcctttgcaccacctgcgcgacgcttcttggccttcttcttaggaccagcggtgccaccgagtgccagatcgcctgggagtgcaacctcaacgcgacggccgttgatctccacaacaaccttctgtgctggggtcttgtcctcatcttcgtcgagctcggaagcgtcaacgtaaggtgcgattgggttatcccaaacctcttcgatccacttggtgtagatctcgaagccttcgtcgttgcccacgaatgctgggttttccacgatgtgctggtggaatgggataacggttggcatgccctcgacaacgtactctgcaagtgcacggcgggagcgctggagagcctgctcgcgggtgtcgccccaaacgatcagctttgccagcatggagtcgaactgtccggagatttcggaaccttcaacgacaccggagtccatgcggacgcctgggccctgtggctcgcggtagctggtgatcttgcctggtgcaggcatgaagttggagccagcgtcttcgccgttgatgcggaactcgaatgcgtggccgcgtggagctggatcttccttgatggagagctcgtggccttctgcgatgcggaacatttcgcggaccaggtcgatgccggtggtctcttcggtgactgggtgttccacctggaggcgggtgttgacctcgaggaaggagatcaggccgtcggagccaacgaggtactcaacggtgcctgcaccgtagtagccagcttccttacagatagccttcgcggaggagtggagacgctcgcgctggtcatcggtgaggaatggtgctggtgcttcttcgacgagcttctggaaacggcgctgcagggagcagtcacgggttccggcgacaacaacgttgccgtgcttatcggcgatgacctgagcctcaacgtggcgtgccttgtccaggtagcgctccacgaagcactcgccgcggccgaacgctgcggttgcttcacgggttgcggactcgaagaggtcagcgacttcttccatcttgtaggcaaccttcatgccacgtccgccgccaccgaaagctgccttgatggcgattgggagaccgaattcttcagcgaaagccacaacttctgctgcgtcttttactggttccttggtgccaggagccattggagccttggcggtatctgcgatgtggcgagcggtgaccttgtcgccgagggagcggatggactcaggtgaaggtccaatccagatcaggccttcgttgatgactgcttctgcgaagtcagcgttttctgcgaggaagccgtagccggggtggatggcgtcggcgccggacttgcgggccgcatcgatgatcttgtcaatgacaaggtaggactcagcggatgtttggccaccgagggcaaaagcctcgtctgcatatgacacgaatggtgcatctgcatctggctctgcgtagacggcgacagatccgatgccttcatctcgagctgcacggaacacgcggattgcaatctcaccacggttagcgacaagaaccttggtgatcttcctagtctcgactgacactaataactcctgatttaaattgatgactcagtgggtagacacatagttgcctgaccaatagtgaatattcttgcacactcaaccccgaagaactcaaccagatatgaggacttactcatattctgggggaattcttctgttttaggcaggaaatatggcttatgttcaggcaaaaaggggatacgcctattctatgacaccgaaacgttatttttggtgttttcgccagtttcgatcggcatgcgaaccatattgccccattctgcccacgatccgtcatagtttcggacgttgttgaaaccgagcagatacttcagcacgaaccaggtgtgggccgcgcggtcgccaacctggcagtagacaacggtatcgtcagctgggttgagatcggcgtagagcttgtccaactctgcacgggtgcggaagtttccgttgggaagaacagcgtccgaccaatccaggttgatcgcgcctgggatgtgtccaccacgaagcacgccggtgtttgaggttgggttgccgtgctcatccaatccggagaactccgaaggggtcctgacgtcgacaagcgtcatgccaccggattgcgtgagcgaaccgagcacctcagccacgaacgcgcgctggttttcgtcgacacgctccacgacggggtagttggcggaggggtactccggaaccacgtaggaggtgtcgcgctcttcagccatccacgcgtcgcggccgccgttgagcaggcggacatcggagtggccgaacagttcgaagacccacagggtgaacgcagcccaccagttggacttgtcaccgtagacaacaacggtgtcatcgcgagcgatgcccttgcggttcatcagctcagcgaaagcttcaccgtcaatgaaatcgcgggtgaggggatcgttgaggtcctttgcccagtcaatgcgcacagcgccggggaggtgtccgatatcgtaaagaagggaatcttcattggactccacaaccttcagaccaggggagccgaggcgggcggaaagccaggatgcagacacgatcctttcagggtgtgcgtattcctcaaaagctgggaatgggtcgaacggtgctgccatgtggggtcgctgccttccataaacgagtgcataaatgggtgaaaattaaatactgtatcccagcatattggttaaaggtgtttgtgtccttaattactagtggcatagttgggaagcaaagaacatcatctgtgctttattgtctattttgtcaacgtgaaaatgcccggcgctcaagctcacattcaagcgcttcgaggtttcagggtttcccacgttgaacatagaaaacgtgtctaaaaattcagtttttattgctgctgatcacctcttgaagaactcaacccaaaagtgcttcaagttatgagaaagtgaaatccaacacccatgaaaaagagcatcgttgtatttgaagtcgaaggcggctccgacaagcacttcgacggtcaccgtaaagacaccatgcctatcgtcaactccataaatgatgctggctggcaggcagaggttgtgtactaccgcccagagtggaccgaaggtctctttgagtacgtatctgaaaacttcgacggctacatctcacgtgtcaacccaggcaacatcccaggcggcgagcgcggctactttgacctgctcacccgcctgtccgaagcagggctcgtgggcatgtccacccctgaggaaatgatggcatacggcgcgaaagatgcgctggtcaagctatcccaaaccgacctggtgccatccgacaccgaggcgtactacgacgtggagaccttccacaaggttttcccaacctccctgtccttcggtgagcgcgtgctcaagcaaaaccgtggctccaccggctccggcatttggcgcgtccagttggtagacaaggaactggctgcatccatcgagccaggcaccgcactgccattggacactgaaatcaagtgcaccgaagcagtcgacaaccacactgaagtccgcaagctcggcgagttcatggatttctgtgaccagtacatcatcggcgacaacggcatgctcgttgatatgcgtttcatgccacgcatcgtcgaaggcgaaatccgcatccttctcgtcggaccacacccagtgttcgtcgtgcacaagaagccagcagaaggcggcgacaacttctccgcaaccctgttctccggcgcgaagtacacctacgacaagccagagcagtggcaggaactgattgacctcttcgcagacgctcgcccagtcatcgcagaaaagctcggcggcgacaacatcccattgatctggaccgcagacttcatgctcggcgatgtcgttgacggcaaggacacctacgtgctcggtgaaatcaactgctcctgcgtcggcttcacctccgagctggacatgggcatccagcagcttgtggcatcagaggccatcaagcgcatcgaggaattcgcgcagcttactgtttaaaactttgcttctcgacgtctccctcccgcaccttgccaggcaaggcgcgggagggagattgttttatttttggtggtttatttgtcgagtaggactgcgacggactctggatccgcatcagagagcatctggcggcaacgatcgtattcgttgtcctcaccaatcagcttcgcagcaagagctagggaagcgatagcccgcaacactccctggtttggctcatgagagaaggggacaggaccccaacccttccaaccattggcacgcagacgatcgagactgcggtggtaacccgtgcgcgcaaaagcgtaggcctgaatcttctcttcatcatttgatgcagatttgataagattttcagctcggtacgcccacaccaatgggctgtcaggatgcgcaatcgctgtcgaggtcaaagttggatcggcgccgagggcaggatcttccggaagttttactggaggaggggcaagcatgtcattaatttgaaccatgtccccaatcctaacttcaaaggcaagtgtgagaagatcatagcgttgtgcaggatatgaaaagaggttgtcggtgggaacggcgagagggctttctcaagttctgaaagaagccagacaaggtggaaaacccacttcagccacccagaaagttccacgctccggctacagatatgacctcgatgggctccgcggcatcgcgatcgccttcgtagttttgttccatgttttcgtcggaaaagtctccggcggtgtggatgtcttcctgctgctgtctggctatttcttcttagggtcgcaattgcgttatgcagatcgtccagattcttccatcaacccctggtggccgatttggcgcacgctacgcagattacttcctgcgttagtgctggtgttgggcgtttccatggtcctcatcttggcgtgggtgcccagactgcaacgaatagaaatagccaaccaagcagtagccagcctcttctatgtccaaaactgggagctcgcatcccaaggtgctgcctacggagcagcctctgcagaagtcagtcctttccagcacttgtggtccatggctgtgcaagggcagttctacctctttgccatcttgttgagcatggcgatcatcctgattcgtcgataccgccccgaatactccgcagtgcgactagcgactcctgtgctggcagtgctcacatccgtatcatttttcagtgcaatcctgtggcatttcattgatcaatcagtcaactactattccaccttcaccaggttctgggagctcggccttggtgcactattggtgctgcatgcgcctcgaattttgatttctgcgaagactaaatcaatactcgcagccgtcggtttgtttatggtgctatccactggattcttcatggatggcgcagagactttccctggattccccgcgctgtatcccatcttgggtgcttgcttagtcatccttggcgacggtaaaatctcggtctttctctcccgaaaatggatgctttggctcggcgatatcgcctacccgctctacttgtggcactggcctctgctgatcattttcaccgctttgttcaaccaagaagagccatccatctggctgggtatcgccgtgattatgctgtcccttggcttggcgcagctgactaacaaatacgtagaaaaaccaatgcaacagcagggaaagcgcccactatttagggaatcccgcagtgctgatgctttgcaaaagctgcgttcctccaggcctgcccgaatgcgtgcgtatgcgggtatcgcagtagtcgcagtcggtttcgccctgacatctactccgcaggtgctctaccaacgagtcctcgatacccaaatgagtgatctcgatccggagatctaccccggtgcactctccctggcgggcttcgatgcccccgaagtaaaacccaaaccaaacccctacgtgctggccgataccgtctcacccgcctgggcaaaaggctgcatgtccgtcttcggcgacgatccatctgaactagcaccagacaactacgacgaagattactgcgctttcggcaaccccaactcacccgtcgaggtctacctcgtcggcggatcccacgccgaacaatggatggcaccactcgacgccctaggcaagcaacacaacttcaaagtgatccccctcgtccgccaatcctgccccaccttcgtggtggaactcgacggaattttcagcgacgactgcatcgaattcaacgaaaaagtgatcgaacgcctcgcagaagtaaaacccgacctcgtggtctccaactccaccagaccgctccttgaaaaaggccgcggcatcgacgaagtgccagaatcatacatcacgctgtgggacttcctcgaagccgaagacatcccattcatgggactccgcgacaacccgtggttcatccagccaggaggcgaaggatggatggtgtcccaatgctacgaagaagaacaatccttggtggactgctcgatcaccaaagacaacttctacgcaccagtagaccccgctgaaaaagaactagccatcagaaacaatatgctcgcagtggatacttcacgatggttctgcccagacgacctgtgtatcccagtgatcggcaatgtgtatgtataccgcgacggcaaccacatgtccgatgaatacgcacaatctttggctccattcctgtggagcaatatgcgcaggcttctggtcgcttaggactctttatataggcggggctgtgttaggccgttagaagcggttctgagaggtctacttctttggggataagtgccggacatagcgtcggaccaaacgagaatgcccacgaatccctaaaggggagttcgtgggcatgtgtgtttggtttccgagcctcaataccggtcacagatgcccacggatggggaattcatcgttggtgggcactgtggtttggtgggggactcgagacagaccagacaggcgtgccaaaactctcgacgaatcgaaaatcttggcacgcctgtttggtgcggaaagtgtttacatgttccagaagtcgctggcgttgaaaccgaggcggtacaaagcacggcgcacgacggggagagacaatccgatcacggatgaggggtcgccttcgatggaatcgatgaaccaaccaccaagtgcttcgagggtgaacgcgcctgcgcactctaagggttcgccggagtcggcgtatcgctcaatatctacatcgctggcctcggcgaaatgaatgttggtggaggaggactccacgatcacttcatcgccaaagatgatggcgtggccggtgatcagtgtggccttgttgccgcgttgttgtttccatctttcgatggtggcttcgcgggtgtgcggcttgccttggagggtggcgtcgataagcagcatggaatcgccaccgatgacgacgtcgcccggataggacggcgcaaccacctgtgctttagccagcgcaagctggcggacgatctcctccggcgcagagccgttgagggagtgaaggagcgcgtcctcatcaacatcagctgggtggatgaggggctcgacgcccgccgaattgaggattcttcggcgggacggggactgcgaagccagaacgatctgcatgtaactagaagaaattcacattctgaaacgcgctggggttaaacgtgttcgggcgagacagacgctcatccaggttgccccagttgttgcggtccttgcttgccgacaccatctgctgtgcagcggcagctttagccaaaccagcgaacaccacggtcaaggcagcaacctcttgatcggttgggttgccagatacgatctgcagaaaaggcttctctgcagccttggtgtcctgagtggtttcttcagacatggttctcctttaaaaaacagtttctatagtggaatgttaccgtgctttttagcaggaacattgaccaccttgcgatccagcagacgcagaccctcaatgatctggccgcgggtctcagaaggtgggataacggcatcaaccaggccacgctcagctgcgacataagggttgaccagagtttcttcgtactcctgctcgtagcccttcatgacctcagcaacgtccttgccttcggtggcagcctgcttgagttccttacggtagataaatccaacagcacctgaagcgcccatgacggcgatctgtgcggtaggccaagcgaatacgaggtcagcgcccatatccttggaacccatcacgcagtacgctccgccgtaggacttgcgggtgatgacggtgatcttgccgacggttgcttcagcgtaagcgtaaagcagctttgcgccgcggcggatgatgccgtcgaattcctggttggtgccaggcaggaagcctggaacgtccacgaactcaaggattgggatgttgaaggcatcgcaggtgcggatgaaacgggcagccttctcagatgccttaatatccaagcagccagcgaactgggttggctggttagccacgatgccaacagaacggccctcaacgcgagcgaagccacacaggatgttctctgcgtagtcttcctggatctcgaagaactcggcgtcgtcgacgatgcgggaaataacttccttcatgtcataaggctggttcggggaatccgggatgatggtgtccaattccagatccacatcgttgatgttttcctggatggaaccgatcatgatgtcggcctcctggcgaggagtttccgcacggttgttggatggaagataagaggtcagctcgcgaacccaatccaaagcatctgaatcatcagaagcagagtaatgggaggtaccggaggtagccatgtgggtgtgagcgccaccgagctcctcctgggtgacatcttcaccggtgacagtcttgatgacatcagggccggtgataaacatcttggaagtctgatccaccatgacgatgaagtcagtcagagcaggggagtacacgtgaccaccagcgcaggcacccatgatcaaagagatctgtgggataacgccagacgcctgggtgttgcggtagaagatctgtgagtacagacccagagacacaacaccttcctggatacgcgcaccagcaccctcattgattccgatcaaaggcacaccggtcttgatcgcaagatccataaccttaacgatcttttcaccataaacttcacccaaagcgccaccgaatacagcgccgtcctgggagaacacacagaccttacggccatcgatggtgccgtaaccagtcacaacaccgtcagtaactggacgcttggcatccaggccgaagttcttggaacggtgacgagcaagagcatcgatctctacgaaagagccctcatcgagcaaatactcgatacgttcgcgggcagtcttcctgccagcagcgtgcactttttctacagttgcttcgcccattggagcttgagcttctgcaagacgggagcgaagatcggacagctttccagccgtggtggtgaggtcaggtttggtctgtgctgcagtcatggtttcttagtctaaatcctgaagggtgagagtgaataatgcgcttggtcgtggtcgacgtactttgaaggcgttgtgcagggttcttgtgtgaacatacaaacgccaaaatacgacccacttcgagggttaatccccctaacaagggactaatcgtttcgctaaccggttatattagcccagcgccaccccccatgtcttaaagattgggtgtaaagagttgccaattttcattggtatttctttacacccaatcatttaagacggcccttattgaacccttattgaattcttattgaattcttattgaattcttttgaacctttatggattcgccgatttacagtggcatgttgccgtgcttgcgagcagggcgagtgacgttcttgtgcttgagcaggcgaaggttgcgggaaatctgtccgcgggtttcgcttggcaggatcacggcgtcgatcaggccacgttctgcagcgtggtacgggttgagcatgtggtcttcatactcgcgctcgaaggacttagccagagctacggtatcgaggcccttggcatcagctgccatgagctccttgcggtagatgaatccaactgcgccagcagcgcccatgacggcgatctgtgcggttggccatgcaaggttgatgtcagagcccaagcccttggaacccatcacgcagtacgctccgccgtaagccttacgcatggtgacggtgatctttggaacggttgcttcgccgtatgcgtagagcagctttgcgccacgacgcagaatgccaccgtactcctggcctgcgcctgggaggaagccggggacgtcgacaagcatgacgattgggatgttgaacgcgtcgcaggtgcggacgaagcgagctgccttctcagaggagtcgatgtccaggcagccagcgaactgggttggctggttggcaacaaagccaacggactggccttcgatgcggccgaatgcaataacaacgttttctgcgcggtctgcctggatttccaggtattcgccatcgtcggtgaggcattcgatgacatcgcggacgtcgtaaggaacggtcgcggaatctgggatgatctcgtcgagcttcagatcgtcagcggtgatgttttcttcaacgccgccttcttcctcgtcgaagtcttccatcggtgcgtaggagcgattgttggatgggaggaaggacaccaggtcctgtacccaatccagtgcttcctcatcggtcgcagcggtgtagtgggagttaccagcggtcaccatgtgggtggttgctccgccaagctcttcctgggtgatttcctcgccggtgacggtcttgatcacgtctgggccggtaacgaacatcttggaggtcttgtccaccatgaccacgaagtcggtcagagctgggccgtaagcgttgccacctgcacatgcgcccatgatgacggagatctgtgggataacgccagaagcctgaatgttttggtagaaggtctgggaaatgaagtccagggagacagcgccgtcctgaatacgagcgccagcgccttcgtaaagaccgatcaatgggcggccggtgtcgattgccagctccatgatcttgatcatcttttcgccgtacacctcaccaagcgcgccaccgaatacggtgccgtcctgcgagaagatgcagacttcgcgtccatcaatggtgccccagccggtcacgatgccgtcggttgcaggacgcttagcgcccaggccgaaagcggtggtgcggtggcgagccagctgatcggtctcgatgaaggagccctcatcgagtaagtaatccaagcgctcacgggcagtgaggcgtccagcagcgtggaccttctctactgccttttcacccatggggaaatgggcttccgcgcggcgagccttaaggtcggcgatcttgccggcagtggtgttgatgtctggaaggttggcgacgtcaatcaaaggtgaggaaatggtcatgttttgaaatcgtagcggtaggcgggggtaacgtccacaatatttccgcggtgatttacatcactgaacaggttcgtgctgcgtgcgggtagtttttaaaggtaaaactttttgggcgtgtcgcccttaaagcgcgcttttcgacgcgaccccactacattggcttccatgaacgttgacatttcacgatccagagagccgctaaacgttgagctcctgaaggaaaaattgctccaaaacggtgactttggccaggtcatttacgaaaaagtgacaggctccactaatgctgacttgctggcacttgcaggttctggcgctccaaactggacggtgaaaactgtcgagtttcaagatcatgcgcgtgggcgactcggccgcccgtggtctgcccctgagggttcccaaacaatcgtgtctgtgctcgttcaactatctattgatcaagtggaccggattggcactattccactcgcggcgggactcgctgtcatggatgcgttgaatgacctcggtgtggaaggtgccggactgaaatggcccaacgatgttcaaatccacggcaagaaactctgcggcatcctggtggaagccaccggctttgattccaccccaacagttgtcatcggttggggcactaatatcagcctgactaaagaggagcttcctgttcctcatgcaacttccctcgcattggaaggtgttgaagtcgacagaaccacattccttattaatatgctcacacatctgcatactcgactggaccagtggcagggtccaagtgtggattggctcgatgattaccgtgcggtatgttccagtattggccaagatgttcgagtgcttctacctggggataaagaactcttaggtgaagcgatcggtgtcgcgactggcggagaaattcgtgttcgcgatgcttcgggcaccgttcacaccctcaacgccggtgaaattacgcaccttcgcctgcagtaaggtgacggtatggggaattcacttgagaaacatattgcagagggagaccggatccacgtcgatctgacatctcctttatccgcaatgttgttccccatttttgaactcattgtgattactggaatctgttggatgggcatcggctttttggatcagcttccaggaatcgatggcaccaaccccgccgatagcttccccgaaggcacccgcaatcttctagtgggtgtgtgggcagtacttgctgcatggcgtttcggtcttcctttaataaggcaacgtcgactccgcgtgatcttgagcgaccgcaaactgctggtccgacgcgcgggtctgcgcaccgggttcgattccattccactgagctacattcagcgagtccaacgtcggcgaaacaccctggtcttaggtgttggtggacaccaccgaccctatgtaatcaaccaggttcccaaggctcgaaaagtggaagcgctgctcaaagatcttacattttggtgaaggcgttatagttaggacttgtgacttctacaggaaaccaagcccacgctccaggaatgcccatcgtcgcagtaattggtgacggccaattagcccgcatgatgcagacctccgccatcgaactcggacaatcactgcgagttctagctggagcgccggattcctccgcagctcaagtagctgctgatgttgttctcggcgattacaccaacattgatgatctgcgcgtcgccatcgaaggcgccgatgtgatgaccttcgaccacgagcacgtccccaacgaacacctgcaccaactcatcgcagaaggcgtcaacgttcagccacgcccagaagcgctggtcaacgcacaagacaaacttgtcatgcgcaagcgtctacgtgaactcggcgcaccagtcccaccatttgctgccattgaatcagtcgaagatgcagtgggattcttcgaagcagttgatggccaagtttgcctcaaagcacgccgtggcggatacgacggcaagggcgtatggttcccagccgatgtagcagagcttcagtcgcttgtggcagagcttctcgacggcggcaccccactcatggcagaaaagaaagttgccctcaacagggaactgtccgccatggttgcccgcaccccaagtggagaaaccaaagcgtggccagtcgtagaatcagtgcagaagaacggtgtgtgtgcagaagcaatcgctcccgcacctgaactatccgcagaactgcaggaatccaccagaggattggcccagaagatcgccacggaactcggcgtcactggtgtcttggcagtggagctttttgaaaccctcgaccaaaacggccagccagagatctttgtcaacgagctcgccatgcgtccacacaacaccggccactggactcaagatggctgcgtgaccagccaattcgagcagcacctccgcgcagtcctcgactacccactgggtgctaccgacactttggctgattacaccgtgatggccaacgtgctcggtgccgacaccgacccagagatgcccatggcaacccgcatggtggaagtggggcgcaagtacccagatgccaagattcacctctacggcaagggacatcgcccgggacgaaagattggccacgtcaacatggtgggatccgaccttgaaaagacccgagccgaagccctggcctgcgcatacttccttgtcaacgctcgctgggattaggtcttttctgagcgctagcatttctccactcaaaggagcatgcttaaccgcatgaaaagtgcgcggccaaaatcagtcgctccaaaatccggacaagctttactcactctcggtgccctaggtgttgtgttcggcgacatcggcaccagccccctgtactcacttcacactgcattcagcatgcagcacaacaaagtcgaagtcactcaggaaaatgtgtacggcatcatctccatggtgttgtggaccatcactttgatcgtcaccgtcaaatacgtcatgctggtcacccgagctgacaaccaaggacaaggtggcatcctggcgctcgttgctttgctgaaaaaccgtgggcactggggaaaattcgtggcagtagccggcatgttgggcgccgcattgttttatggcgatgtggtgatcaccccggcgatctctgttctcagcgcaacagaaggcttgacggttatctccccaagctttgagcgcttcattctgcccgtatctctcgcagttctgatcgctatttttgcaatccaaccgctcggtacagaaaaagtcggcaaagccttcggccccatcatgttgctgtggtttgtcacccttgcaggattgggaattccgcaaatcatcgggcacccagaaatcttgcagagcttgtctccacattgggccctgcgcttgattgtggctgagcctttccaagcatttgtgctgcttggtgccgttgtcctgacagtaacgggtgcggaagcgctctacgctgatatgggccattttggggcgaggccaatcagagtggcgtggttttgcgtcgtcatgcctgctttaatcttgacgtatttggggcagggcgccttggtgatcaaccagcctgaagcggtgcgcaaccccatgttttatctcgcgccggaaggtctgcggattccgttggttattttggcgaccatcgctacggtgatcgcatcgcaggccgtgatttctggtgcgtattcattgaccaagcaggccgtgaatttgaaactgctgccacgcatggtgatccggcatacctcccgcaaagaggaaggccagatctatatgccactggttaatggattgctgtttgtatccgtgatggttgtggtgctggtattccgatcctctgaaagcctcgccagcgcgtacggacttgcagtgaccggaaccttggtgctggtcagcgtcctgtatctgatctatgttcacaccacatggtggaaaacagcgctgttcattgtgctcatcggtattccagaagtacttctattcgcctcgaacaccacgaaaattcacgacggtggctggcttccactacttattgcggccgtgctcatcgtggtgatgcggacctgggagtggggaagtgaccgcgtcaatcaggaacgcgcagagctggaacttcccatggataagttcttggagaaactcgatcagccacacaatattggtctgcgtaaagttgccgaagtggcagtatttccacatggcaccagcgatactgtcccgttgtcattggttcgctgcgtgaaagacctcaagcttttataccgagagatcgtgatcgttcgaatcgtccaagaacacgttccgcacgtgccaccagaggaacgcgcggaaatggaagtgctccatcacgccccgatcagagtcgtgcgagttgatctgcaccttggttattttgatgagcagaacctgcctgagcatctccatgccattgacccaacatgggataacgccacctacttcctgtctgccctgactcttcggagcaggttgcctggaaagattgctggctggcgtgatcgtttgtatctttcgatggaacgtaatcaggcatctcgaactgagtctttcaaattgcaaccaagcaaaaccatcacggttggaacagagctgcacctttaatcaggcagttgctggccaactgagttagcctaaaacgatgaagaaaaatcctttggttgaatgggtctgggttatggatgaactcggggttggctggtgccaatgcgagaaagattccatcaccggaaaagcaccacatcccgtgaacaagccactggtcaccaaatccattatcagggctctaggcgatgtccccgatgtcatgagcaaccaggacatcagccttgtggtggtggatttgtggaaattcgataccattactcctccaatcgcagaatccctcatgcgttccgtcaaagctgttaacggtgagatgcacccgcagtatcccaccgcgacagcaatggctgcgatcaagcatttctccaacacttttgatggacagattaacgcttaaaaggcctgttatagactgataaaccgatacgtaactttcgcgcttaaggagaatttcagtgggtcctctagttggtttgatcatgggttcggattcggattgggacactgtagcgccagctgcagaggtactcgctgagtttggcattccttttgaagtcggagttgtctctgcacaccgcaccccagagaagatgctcaactacgcaaagactgcacatgagcgcggcatcaagacgatcatcgcgtgtgctggcggcgctgcacacctgccaggcatggtggctgcagcaactccacttccagtcatcggtgttccacgcgcattgaaggatctcgacggtttggattccttgctgtccatcgtccagatgccaggcggcgttccagtcgccactgtctccatcggtggcgcgaagaatgcaggcctacttgccgttcgtattctcggtgctggtgatccttctttggtcacgaagatggccgattaccaagagaatatggcgaaggaagttgaagccaaggacgaagcactgaagaagcgcttgctcggctaatgaatccgatcgtggtgctgggatccaaagttgttgatggtcaagtcactggccttttggcctcaaggctggaaaaggccattgaggtctcatctttgaccccagaagcacccgttgtggtcagcggtttcggtgaagccgccgccatggcagattatttacgcgcccgtggagtgaccaccattgtggaagaaccatgggccaccagcaccaatgagaatttagaaaacgcccacgcattatttccggacacactacagtggactgttgtgaccagtggctttcatgcctggcgcacctatttatgggcttggcatttagggattcccatcaaggtggtcactgctcgtacaccttcagctgagcgcctagggatggcgatgagagagtgttttgcactgccgcattcaacacttcgagtgctgtggcgaaaaatccgaactccaaagaactagcctaagaactagccccatgagctatccctcaaaaaattactgatagtgaggttttcgcatgtcaactgcatattttattgcgcacggaaacgatacgtaccgcccaacggagcattccagcggtgtgtggcgcgatgatgaactccaccttgcaccggttgccggtttggtgattcaccatatggaacgttggcgcagggaagtggttggcgatgctttggtgttcagccgttttagtttggaggtcttgggccagatcgctcgggatgatgtcaccttgagaacagagatcgttcgtcccgggcgcaccattgaacttattgaaaccgtggctgaaatcaacggcagagtgacgattcgtgcacgcgcctggttgctgaagacctctgatcttgcccatatttctggcgatacttttgaagcgttgccgtcaatgactgaactggcagatgttaagtcagcgttccagtggtctggtggatttatggacagcattgtgtttgttgaggacgctgagaaaattccgggcaaaaaccgcgcgtggattaccggcgatgtgcagttggttgacggcgaagattctgagcctttggcagagttttccaaattcttggatgtggccaatggcgtggcggttcgggaagatccaaagacttggatgttcccgaacgtggatcttactttccatctgttccgccagccggtgggcaccaaggtgggttttgatacccgcgcggcgtttggacccaacggcatcggtttgaccacgtcggtgattcacgatgccgaaggtcctgtgggcacgcttaatcaatcattgacagtgcgcccaattgctgagttaaacaagtgacctagttaaacaagtgaccgggctgaataagcaacctggttaaacaagtgaccgcgcagcgtggtgtgactgtattctgtgcggaatcggccacgtcgctgcagttcagggactactaagtcaacaaagtcgtccaaactgtgggggagcatcggtggcatgaggttgaagccatcggcaccgccctcgtcgatccagcgctcgatttcatcagcgatgctttccggagtgccgataaatgtggcgtgcccaccgcctgctgcgaggtagcccaaaagttcgcggacggttggtgatttagattcgatgatccgcaggaccgtttcgtacctgcctttaggaccggaaaactcttctagcggtggcagtggtgggggaggtgcatccaaatcccacgtcgagcaatcttgacccacaaagaaactcaactgatttagtgagtctttgaccggcagcaacgcattaagagcctgctgttttgcacgcgcttcttccacggtcgtgccaacaaaagtcaccaaaccaggaagcaccggcatgggctcgcgaccctgggcagtggcacgagcatgaatatcagagcgataatcttgcgcttgctccaaatcccacgccacagagtaaattgcctcggcgtatttcgcagcgatttcccgtccttgcggtgaggatccagcctgaaaaagtacgggtcgaccctgcggaggactggggatattcagcggaccagcgacttggaagaactcaccatcatgatcgatagatttaatgagcgaggagtccgcaaattttccagcacgatccatcaccaaactttccgcaggccaagaatcccacagcgcagtgatggtttcaataaattccgcagcgcgcgcatagcgaacatcgtgacccggcaacgcatccatcccgtggttacgcgcctccgcatcggtcatcgatgtcaccacattgattccagcacgcccacccgaaatatgatccaagctggcgatcatccgcgccgcatgaaacggctgccaaaacgtactggaaattgtgctgatcaacccaatattgttcgtcgcccgcgccatcgcagtcaacgcggtcaccggctccaaaaaccagcccggcccattctccagaccgaccggattaatcgcctgcccatcggccaaaaagaccgcatccagcttgccccgctcagcggtgcgcgcgagttcctcccaccaggaaattaaacccagcttttcgacgcttccctccaccgctcgccacgccgccgcgtggtgcccggcaccgaaagcaaaaaggttgaggtgtatttctttcggtgtcattagttgaaaaccagtctgtaaagtgtcagcacgttgtgcacacccaatgtcatatccttgtgcacgccctatcccactaggttgtgcacacacaaagccacagcagtgtgcacaccaacccagcccctcgggacaagtttctagcgcagaagatcccccggatctatcgacttgaatcgcttctcagcctcatcacgtttgcgttgccacaacggtgtcgggtgttgcatccacaccccacgaatgttgtaagaattgatatacgacttaccccgggcaatcgccacaaccggcaacggaatcgacaactcaagctccccggttatcgcatcccagaaaccaagctcagttgccgtcaccgtccgataaaactccctgtccctcatcgtacgaggaacagaaatacgcatcccctggaacaccaccttctgattattcccagcaaacgtaaacacatcaggatccaccggctttttaccaaaacgacgtacccgtcgacgttgctcggtctgctgcatcttagacaccggaacagattcctcctgccgaacaagcgggacatctgattgcttctcaattcgacgacgggcatagtgatcggcttgctgttgaagcacgacgggatcaatcgggggttgttgttccacacagcccacaatctcccaggccgcggccggggtgagattattcggcaacccctgatgcgggcgacgattgttgtaatgatcgcggaactgttcaatatagtgcgcacattcctcaagtgtgtgtggttgatgagcttgaaggaaacgaaatagtgtgcggtggctgcgttcgtttttaccttgggtttgaggatgcccaggcttgccggtaatgcttaaacaccccaccgtcgcgagatagctttccaagcttccgacgtatccttgccgcatccggttaaacgctgagccgttatcactgagtaattcatgcggggcaccgaaatgagcaatcgcttgttctagcgctgttcgggcatcgactgagttttcattcgcggggaagacacaggttccgacatcaaaccgagtggcatcatcaaggatttgatagatcgttacccgagtcagatcagtatcgtgcagtgtgtagatgaaaccatctatttgccacatttccatggcttgacctcgttgaaacctcaccaccgacgacttcggtcgcttcttagggttactttcaacagctcctgcggcgcgtaacaaacgagcaatggttgaaacagatggaatcggtgcagtcagttccccggtggagatgccttcgaatcgaatagagatcgggccgtactcccatccttgggctttcaggcgtgcgcggatggacagcaaggtgctggtgatggattcatcgtacgttcgccgggcggtgattggggcgctggagtgtggatgcagtgctgcgttggcgtcttgttggtatcggttgcggatgttgtagaagctgcgccgcgatatttttagccgactgcagaactcttcgatcgaggggctgttcggtgcgaacggatcgaaatcgatgatcttgcgtcgggtttctgggggtaggggtttaggcatgatgtcaattgtgagcagcctaggactatgcctgtggtgtaggtctggggtgtgcacaaggtcatgacactatgcatgcacaaggtcatggcattaagtgtgcataaggtcatgacactgagtgtgcacaaccctctgacacaaaacagttgaaaaccagtcctccgtcgacgaccaagttttggcctgtaaccgcgcgcgaccagggggatgcgaagaagagggaggcgtcggcaagctcttggggagtggtgacggaccccagtggggtgccggcggcgatgaaatcaaagacttcctcgggcgtggcggcgctggcgccggtggtgcgcagcaggccgccgctgaccatgttgaccgtgatgtggcgtgggcccaaatccttggcaaacgtgcgagtcaaggacagcagcgcagccttcgcagcggtgtaatcgtggtaggggacagtcggattctggaaaagattcgtgccgatgttaatcacacgaccacttcccacctcctcaaaaccaggcaaagcctcctggatggtgttcagcgcgccctcgattgcgctggtgtactgctgattaaaacgctcaatggtgatgtcctccgccttgggacgcgcatcgccatcaaagctgaaatccgccaaagcgctgttgaccacagtggtgatcgggctgccgaaatgttccttggcctgcgcaaacatgcttttcacctgttcgcgatcacgaacatcagcctgaatcgccaccgccttttcaccagccagctctgcggcagcatcagccgaacggtgatagttcaccacaacacgagcaccctcgcgcaaaaatgattcagacaacgcgcgaccaagtccgcgtgcaccgccggtgaccaaaacaatttgctcagaaatatcaagcatgaaaaaacgcccttcttgggttggggcgaagggcagagggacctatcccttgggaggatgggtccaatgcgacagtcccttcgccagtactaactggatcaggttcgacgggtgtaatctcagcgaaagcttttttaaagtgcttttgcaccccgtgtcactagtagccgagggtatcagtttgtgagcgcgtgtggggcgagttggtacagaagagcaattcaggccgacaccacaaactccgatctaacaaagatttgcgctgccaactatggcagttttggatcctagataccatgcttgtaaaagtactgcaaatggatactggactgtcgtaacggtataccatagaaacaatctgtaatcctctaaggagcgcgatgaaagattcgtctaagtttgcgacaaaaaattattctgctcgactgttcttattgctttatgtcttaacggtcgtagtcgggtggatatttgcccttgggaatccctattcagtagtaaccgctttttcaatttttgttggagttggttttgctgtagctgcagttgcttgtgccctaacaagaagagctcccttgtggcttttggggttcttaggtggtgtaggaatcgttcttgtcttgatgggaatctatttcagggtaactcagcctgatggaatcctaactggatatttgataccgattggttttggattttttctcgcagaagcagctgtggcaatagagcgttattggcatcgtcgtcactaagcactgcgttcttaaaggaagagctttctgcccaaaactctacaaattaagcccctttaatcgtctccagggtgatctcggtgaattgtccaacctcgcggacatttacggtgcggagacgattactttcgatccggcggggcatcgctggctgcccttcatcgagaaacactggcgccatggtcaagatgatccgatcgagtgcacccgcatcaaagaattgacccgccagatcgccaccaccgacgatccaaatatcagtgttctctggactctcttccagtatggcggggagaacatcggcgacatctccatttactaccttgacaggttttccttccggggtttccaagttcctgctgctgaacacccacgtggggcgatcgccatacacatcggtccacttgtggggatcgctgatgaaatctaggtccttgagcagccattcataggtggtggatcccattacgatggtgccggcttttgaaaggaaattaccgaagtcttcagaggcaccgtcgctgccggggacgtcgaaaagccattgcagggagttgtctttgtctgcgatgaagccgttgagcgtgctcgatgtgttgtagatgatcgccatcacacgatgctacctacgatggggatcatgggaattaaacgtttggacaacgtggcgattgtggtggaatcgttggatgaagcagtcggtttctttgagaaattagggatgtccctagatggccgaacaatggtccaaggggattttgctgatcggaccgttggtctcagcggaattcgatctgagatcgcggtgctgaaaactccggatggacattctcgggtggagcttactcaatatctacaaccggaaccgattgcaaccgctccatctgcacctaaccagattgggatgcaccgtttgatgtttgcggtggatgatattgaggaaacgatcgaacatatcggtgcggaaccactagatgggatcgcaaattacgaggacacctaccgattgtgttatctgcgcgggccatctggaattatcgtggcgttggcgcaggaactttaattagggcggcgctttcgccaagccctccatactgacactgtggcgattactaaaacgagcgcgagaagagctggccacacggcaggttcggggcgtaacacgttgatgactgcctggatgacggcgaggaatgagaaaaatcccaggaatccaagcagcgcttcgggttgaagccctttgcgttgcgattcggattggtcctgggatttatcagcactcatgagtatctagtctaggctttcacgccacctgcggtgagtccggagacgatgcggcgttggaagatgagaaccatgatgatcagtgggatggtcaccaaagctcccgctgccatgacagaggcgtaggggtattcgaaggagcttggtccggtgaaccttgcgatcgcaacggtcactggctctgtggaggtgttggatagttggcgggccagcatgaattcgttccacgttgcaatgaatgcgaggatcgcggtggtaaatagtgcgggcgctgctagaggaagcaggatcatgcggaaggcttggccacgtgtggcgccgtcgacacgtgctgattcttcgagttcccagggcagttgcctgaagaaggatacgagcgtgtagatcgtcagaggtagcgcgaaggaaatgttcgggataatcagcgcttggtaggtgccgatccagttgaggtcaccgaagagctggaacagcggagtgaccagggcgatgccggggaacatggaggctgccaagatgatgccggtgacaatgcctttgcccgggaattccagtcgggctagagcgtaggcggtgaacactcccacgagaacagcgatcgctgttgtggtgacgctgatgaccagtgagttgccaatggctgcgaggaagttgttgcctttgtcggtggccagtgcgtcccggaagttatccaaggtgacgtgcgttggccatggggtggtgtcaaaggtgtgcttggaatcgcgcagtgcggtgataaccatccagtagaagggagctagtccccagaagaggatgaacaccactccggcgtagttgaggatgagtccttttgttcgtttagtcatggcttagcggcttccttcacagcagaatcggcctttacaacagcatccttagcggtgggtttctcatccttggttccgcccagtttctttttctttattccgcgttggcccgaaacatctgcgccgaggaatcggatcatgatgaacgccacgaagaagatcagcaggaagatcagtgtggaaagggcggaagcggagttgaagttgttttggcgcatgtcttccacaaccagctgggagataacagcggtgggggagttggaggagctggagatcatgatgacggggaggtcatacatgcgtagcgcatcgagggtgcggaagagtactgccaccatcaaagctgggcgcaccagcgggagggtgatcttggtgaattgctgccacgcggttgcgccatcgacgcgggctgcttcgtaggtttccttcgggatcatttgcagaccggcgaggatcagcagtgccatgaatggtgtggttttccagacgtcggcaagaatgacggcggctctagctgcccacggatcggtggtccaactgacactaagtccaaacatggagttgatgatgccttgtggtgcgaagatgaactgccacagttttgcggtgacggcggtggggattgcccaagggataagaatcgctgcgcgaacaagtgcgcggccacggaattctttgttcatgatcagtgccatggcggtgccgaggatagtttccaagccgacggtaaccacggtgaagaacaacgtgatgcgtagtgctggccagaagtcggtggctagtgtgccgggtgggcaggtacggatggtgccgtctgaacccatgcatcgttgggtgagccagtagaggtaattgtctagtcctgcgaagccaccgtcggtgaagagtccggtggtggggtcgaggcctttgtcggcctggaaggatagccaaattgctcggacgatgggatatccgatcaccactgcaaggaccacgagggcgggggcgatcagccaggcagcgcttctggcctgtttgaatgtggccatgtgtcgtcgctccttttgtcaggtcaaaataagttgattgtcagttctgtgaaactgcacattcttgttacatggatcataatccgccacacatcgtgatggacacattgcctattgcttataaaacccgtcgcggaggttcactccgtattccagccacgcttttagtgcggacagcatgccagtccatcccatctggctgcccagagcctcttgggctcctgcgggagtgagcggccaactgccttcggtgatggtgagtttcgtgcgggtgaaatttctaaaaggttcgaactcgaagttgacggaacgcagctcatttgcttgtccccagcggagttcaatgtgttcagcctgtgtagctgagacaacttggaccggaaacgcaccgggaaaatcaacgaagtcccaatagacagtcgatccggtttcgaggcggccagatactccgccggtggcgaagtagcgttctagttgtctgggatctgcgattgcttcgtagacctgcacggggcagcgggagatgtagccaaatgtggaaacttgaagatctttgccggaagccatccggactcctttcacacaagttcaattacacccaacaataggacaaaactccggccacctttgtggaaatccgctaaggatttcagggaaggtggccggagaatgaactaaattaccgaactagctggaagcgttttcgatcgctgccttcatatcggtggttgcctggtcaacgtcgacgttgccgttaagcgctgcgtaggcgttgtcctggattgccttggagatggctgggtagaaaggagacactgggcgtggtgctgcgttttccagggattccttcagtgctggcaggtatgggtactgctcaacaagggactcatcatcgtagatggatgccagaactggtgggaaggagttgtccgcgaaccaggtttggttctcttcgttgatgatgaattcgatgaagtcgcgggcggttgccttgttttcggagttgacgttgatgccgttgttgtagccaccaagggtggatacgccgacgccgtctttacctacgaggggctgtacttcgaatttgcctgcggttgcttcggcttcttcggagttggtgtacatgtatggccagttaatggcgtaggcggtttggccttcggtgaatgcgaggttggtttcttcttcggtcgctgcaagggatgccttggagatggtgccgtcgtcgaagccgtcgacaagcgcttgaaggcctgccttggcgtcgtcgctgtctacggtgacgttgccgtcatcgtctaggacgctgcctccccaaccttcgatgaagccgatggtgttcactgaaaggccttcgtactgcttgagctgagtggtcaggcaatcaacgcctgcttcttcagcaagcgtgcaggattccacgaggtcagcccagtttgctggtgcttctgggatgatttcggtgttgcggaacagtagctggccgttggtgttctgtggcagtgcgtagagggtgccgttgtaggttgcggaatccacggtggattgcagcagtccggaggtgtctacctcgaggtcgccttcaagtggtgcgagccattggtttgccgcgaagtctgcggtccagatgacgtcgagcgccatgacgtcgtagtcagagttgccggcctgcagggattgcacgagggtttcgcgctgcgcgtcggcttcaccggcgagttcgttgagcgttacctgctcatcggggtgggcttcgttccagcggtcgatgatcggaatgactttgtcggtgtcgtttttgcccatcgcaaaggtgatggggccgcggctgtctgcgccttcgctagcggtggaatctgtggagtcggagcttgagtctgaactacaaccggccagtgcgatcgctgccaacagtgtggtggctgcaagtgacgcgccggtcttgcgggaaatcgaggacataggaagtcacctttcttaacaacagatgcttatcaatctaatgacctcgaacacgtttgtgtggaattttaggttaaatcacccccggagggtcaaaaataaagatgcttttcgacgcctccccacgtccgaaactaagcgatacgctcgcccgactccagatcgaaatgatgcgcctgcgccgcatcataggaaaaagtcacaggcgtgccaggggctggcacggggccttccacccaacgggccaccaggcggtggccctcccaagtggcataaacatacgattcggagccaagctcctcgacgatatccaccacagcatcaatgcttgtgaaaccctcaggggtctcattgaccagcatcttctccgggcgcacacccatcttgtgcccgttggcagggaagaggttcatggacggcgagccgatgaagcccgcaacgaattcgttgaccggggcgtcgtaaagctccctgggcggtgcgacctgctgcagcaacccgtccttgagcaccgcaacccgatcgcccatcgtcattgcctcaacctgatcgtgggtgacatacaccgtggtggtgcccaggcgacgctgcaaagcagcgacctccgcgcgggtttgcacgcgcaatttcgcatccaggttggacagcggctcatccatgaggaacaccttcggatcacgcaccaacgcgcgacccatcgccacacgctgacgctgaccacccgataaatccttaggcttgcgatccaaaaactccgtcaacccaagaatttccgcagcctcattgaccttcgcatcgatctgcgcctgcggcagcttagccaacttcagcgcaaaacccatattcttcgccaccgtcatgtgagggtacagagcataattctggaacaccatcgcgatatcgcgatccgccggctcctgaccagtgacatccttgccatcaattttgatcacacccgactccacgccctcaagccccgccaaagcacgcagcgtagtggatttaccacaacccgaagggccgacgagcaccaaaaactcgccatcagcgatatctaaatcaagctcatgaactgttgcgcgctccgcgccggggtaccggattgtgaccttgtcgaatgtgaccgttgccatgttctactaaattaccagcaccagtacacattgtgggtttagcgggtctaaattgggaccgctgttcaaggtcaggagcagaacgcatggctactgccaaagttcgcgatcggtggcaacaactcttttggggcggcatcaagctcaaaggactcaacggcttatttgagctcatcggcggagtgctcctccttcttgtcgatcccgaaagccttcaccactggaccgttctgctcacccaaaacgaactgaatgaagatcccgacaatggcatcgccacgttccttgggcacagcagtgaatcactcaccagccacgctacgttgttcagcgctagatatctactgacgcacggccttgcgaaagtggtactcctggtcgcagtcctgaaaacaaactgtgggcatacccgtggatgattgctgctggctttcatcgcgtatcagctgtaccaaatcgcacttcacgccagcgccggaatgatcgcgccgacaattttccacagtatcggtgtaactcgggaaaaactccaccacgtatggatctgcaatgtcgacggcgtagttggtgtctcctgtttgattcgtattgatattgagaatctgatccatcaccagctcaacgggagcaccagaacgatcacgttttctcgtggttgttcatctacgctttcactgctccatgagacaagcgatgcgccaagggcaagagttgctccgattaaggctaaagtgcgtcgtgtatttatgcgtccaattcgaattttattggggttgggatcttcgcgatgatactgaaagcaccccagccttagtcggtcccacagctgcttttagctgtgggtagctggtgttatctactcagattttggcatcgcaaccgccatatggtgaagcaagtccaatgcaatatcgcgccttaaatcgagatggaaacgctggttagaaaatgatcgcaaacaggcataacacgaagtatcgatgccacaagaacaggtttcgacccttctaattgccgcttcgagtacttgagggaagttttctcgaacttttcgggtaataccagctccaccaggaacagtatcgaacaacaccatcgttggcctgttgtcgtgtttcgccatggtgccgtttagatcatcacgattgatttctaaacattcagcagctgcctcgatgatggcgtacattccagagcgccacccttcgaagtcaagatttgtataagaaggaacggcaactgtcgcgatgtcagtttggtaggtgtgacccaaagagtggggttctaagtagtaggtgccacactgctgcttagttctggggtttcgatggcttttagggatttcggcgccattgggagtgccgaatccgcatgtttggcaataccaaaatccattcttgttaggacctgtttcaagcgctcccatctccgtccgactccaagaagaagtaagtacttgcgcagttgctgtcccatctgaatttgagaactcttcactgtcatctttgacaccgaactgctttacaaattcaagtcgattagaggatcggaccgggggagcagtgcccacttcagttggatttgggtctgcaacgaaaccaaaacgagggataaggaacttgttctctttacccagcgatattggtgcagagcactgagaacagacatcttcagatgtaaatccaaaacgagaggtttcagtatgtttacactcagtacacgttgtccaataaaaagtttccacctttttaccggctaggtgtcgaatgccagcggatttccacaattttccgcctgctactaactccgcaccaggagcatagtcggtaatcgctagctgaagatctcgtgacaagctcaccttatttccagcttcactgaagtttgtttgaagatctactgtatcgacagggaagctgtacttgggcagcatgttcttcttggccaagtatcccaaaagatcttggtccatcagagttgtgattgtgcgtttgaaggcatctgcctttttgccttgttcactgcccagcgctcgcccttgcatctttttaagcgtttggaaatcttcggagatctcctgacgagttgtatcgaaaatttcaaggaattgtttaacccaaccttgattttcaatatccagatcctcatgcagggactcagggaatacgcgacggagggcttcagtgatgtaattaggaacaggggagagaaactcttcgaggatctccgttgcctcttgctctgcgacagcaggcctaaggtatggagctgcatcagtgccaaggaagaactctccggcctttttccagaaccgattttgggcagcctgctctcggaaaaatgcggcgagagcgattgaataggtgtgacgacgggcgattcgggcattgttaatgtgcaaaaatggcactgtcatttcgccatcaatcatctgggttgggttcttaaatacagccaagtcatgagaagatcgcttagcaaaggtaagcacaaaagctgctgaacctgatcggcgtcccgcacgtcccgcacgttgcacatagttagccgtacgtggcggtacgttgcgcatcattactgactgcagatcaccaacgtcaactccaagctcaaacgtagtagaacagcttaggacattgatttttccttcgatgaattctttctgaacctctgcagcctccgttggcgtccattgagcagtgtgctctttggctgaaagcggaagaatttcaagcgatgttgccaacttccgataatgattgttggcatactccggtaaagaagtatcgatttcttttagcttgcctttacagaacccatgtggacacagcccgagaacattaaatggcgttgtatttctacaagtgtcacattcataccaggaatgttgttttccagggcttacttgcagtgagttgtagttaagtgtgtagccttcggccttttcgcctgggaccttcaaaatttcggaattagtgtagtcattccataggtgatggagaagcgtcgtaatattttcaccttcgtcacctgcttgtccgatgcggttcaagacttttgtaatgaagtccttgcgattgttggttcctcgttgcggaatccatgagtagaggcgtcgtgttgattttcttccaccatctttggtgaaaaagtgctgcccacgacgagggccaaagcgttcatcctcaagattgacgtagtcagggcaattgattgcgcccttgtgacggaattcttgagcgaagagattaaaaaaggcgtcggcggcatccggatccccaaacatctcgccaagtggttttctgaaactgagttgcgacaaagcctcaggggtcagttcaattttggctagtccaagcccttcagtcgaactacgtcggactgtcgaagcaagatctgcgaatacccagttacctgtctgttctagtgtttcgcgtgggttcaagttgttagcgaggactcgattgtttttcgccacttcacttgcgcgggaaatccatcgttcaatggatgcgccttcagtaaattcttcatcccgcagggtctcaatgaggattcttcgctctagcaacctggtgtaacttgcttgcaaatatggtgctgcgtaagcggcagcctggcgggagtcagaaaacgtgagtagtttgcgtccagcaccgatcttgcgtgatgtatcttgatcagctgattctggcaacagttggaacaatgatgtggtgaggacagaaggtgcagcatttgaatcggttcggagtcgtcgaatcaggttcttttctcggccaccgcatcgagtgcatgttaattggctaccattccggggttccaagatctttacatcaataaactggtcatgatgtgatgagcatccggagcagagaagagagttctttccgtttagttttccgcaggccgtacataatttttgtagctcaaggactttgacgttctcgtcagcatcagtttctaggtcatcttcgtcgatgtctgctgtttcgaaatcatcggtgaggactacccatttgagctgttgttcgtcgaaatttgaggaattctctggaggcacaaggaaaccagaatcattatgggcgctgatatgaacggttccacatttgatgcaagcacccatttcatacattggtcgagctgtgtcgcctaatgtcacttgccggtccaaggacacgattggctttccttgctctgtatacccaagaaaagcgccttcaactgcgcggacaaacatgtgataacgcgcggacagagctggtactccatcatgggatagaacgccactgcctaaattcaccagcatatgtgtgcggtgcattgatgctttatcagtaacatttggccaaagacccttgccgatgtcttcaactcgagtgcttgattgctgggatagttcgcggagttttacgatgtgttcttctttggagagctcttcgtattgatctccaccgcgctcttgtagtgcttggaaaagaccatcactttctaaaggctggtcaaagagctcatctggtagggaccacgtaaaggtttttggtagttttctccgatgcgcggataccaaatcctggcgcgagggatcttcgttgacaaactcaaaaggttcaccaaagaggtcttgtccaaaggtcatgatggcttctttagttccttccaaagaagcacttgtagcgatgcactggaggggatttcctcgttggacacgatctttcaggcgcctcatcagcatgccgacttcagtgccttgtgctccggcgtagacatgagcttcatcaagaacaaggaacttccaattattggaatatgcatcatcgaagaatgcgttgtctgcaggacgaagcaggaggtattccaacattgcgtagttggtgagcaagatatgaggtggattttcctgcatctcatcacggctaattagctcattaggtagaggggtcgcatttcgcccattaatcagtttgaagtatttctcggcttcttcacgggtctgtttggtatctccggtgtatcgaccaaaagtaatttccggggtgtctgccaataattcgcggagacgtttctcctgatcatttgcaagagcattcatagggtaaagaagcaatgctctgacaccaggatttaactcaccggcttgttgttggcggagcagttggtcaaagatcgggatgaggaaagactctgtttttccagatcctgtaccggttgaaacgattaagtttcggccactagcgatttttcgcagagcgtcttcctgatgctgataaagcgggcgatctttgggtagtgcggcatcgagacgtgagaagtttggagaaaggactccctcatcaattaattgagcaggggacttacctggtgcataaggcggagtcagctgcaaaattggtccgtagacaaggttttcggactcatcaatctctcggttgaattctgccgcaattgtcttattactggggctaataagtgttttcaggtagcggcggtagtcgcggctgatttgttctgctgcttcgactggatcaatatttcgagtgacttcagtcttggcattgactttctctacctcaattgccgagagcgtaatagttgtttcagtttcggttgctagtggggaaaagaagtctgaaaagctctttttaggtgcgttggacatagtgatccttaaattgcagttgggattatattgttgttgtttattgcgctgagcactttcgcttcggcactcaccaggtcaaatcctgtgagacgaggaatcagccgagcagcgtttgcccaatcgtgccgtgagtaattgatctgagcgatcggacgtattacttcatgagcgatcattcggttaagcaagctgtaaatgaatgacacatatggtgcataaagccagttttcagcgttgccgcgacggtgttccgacgcaagagtagacagctcacgtgcagtgaccttgatgcgatcatcacctaagtgatcgatgaggtactcgtatttctcggcgaaatcgaagagcgttgggagctggccgagatcattgagctctcggcggttttccaaccattcaagctgagctcgtaggcgtgagtctgctgaaataaactcggcgctgaactgatcggcgcccagcccattgcgcatagcttccaagcctgaattacgaatcacattaatctcagtggcttgtggtgcgcatttttgagcaagagacaatccctctgaatttccttttaggatattccacaattcactgcctcctatctcacggatgtagctctgcgaatttcggcgttcgatggctcgttcttctgtttcatagccttgtatctgcagaattctgaggtcgttcatttcctggatcaggccgatccagggaacgcgatggatatctccggctgtgtcgtcaacttcgaaagaaagctcagctaatccggatcggatgaatgattcaaagtgggaattagacggaattgagctcttatccaattcatctaatgccacccgaggatcactggtgagataggtactggtggcatcgtcaaaatcttgaatcgatttcacatgaaggttttcacgctgcgctaagacatggcgcatattgaatcgggcgtcccacactgtgcggatttcttgtgggagtaagaccttcccacttcgtggagcgaacatccatcggtgtgtgaggaaaggatcaaattgagggtccaattcaaatgagggatcatttgcaaccacggctttaactgagggaacttttggctgccattgggagagaaactctttttctctcacttccacgattaaagggccaacgacgaagtgggtgtctggaagtgagcctgaggttccttggaaatcgactttgattggtggatcaagcgggttgagcgcagaccatgcccagccttccagtctcttagaagtgtgccgaccaagttccaactccacggtagaaagcttaatttcagccgcagctagtaggggctttttctcaattgttgcaatgtgggaacttgcttgaggttgaggacgagcactcttaagcgctgcattggagatttttccagttcgcttagcttcgctaatgatcttctctcggtgctggtctttactttcagcgaaccactccgcgatcaaaaggaattgggcatcatcatccatgagttccttgatgcgatccatagggatagaccacactttgcttgaaccaattttgcttaagtatttaggctcactggactcaggtttcttgtatgccaccattttaatgattttcaagtttggatcatagacttcattagggaatctgatctggaggtttccatcggcaaagtcattgaaatctagtgtcgtctttgtgctttcccactttgtttggctgtgtgtgacaggtacttggtagtgaagttgcggaggcgtgatgaaaacgtcgaggttgtagtcctcagggaaatcaccgcttgcgatgttaaacgctttttgagaggtgaatgcatcaagcccgatgatctcatctgggaacctgatgtgcttttcagaattggaactaaaacgggcgaaagtctttgttaagccagtttgtccctgattgatgctggggtacctaaatcgattttcaggtccgcctccgctgaatgttagggaaagatcgaggccttccgcgagattgaatttgcgggtttcatagactttttcatccttgagcagagttactaaaaattgcccgacccaagggtcgtcggattcttcgaagaggtctagttcgtatccgaagttttcaggttcgactgggtaatcttccatttcgatgaggctgccatctggaagaatctgtgaatactgaattacccagtttgatccagaggtggggaattcgatgcggggactcgtgtggaaaacgggctcatgatcgagaccttgaagattctcgatcgtgagatcctcagtaatccattgaacatcaactttgcgtcgaactgggagttcttttctgaagccaccgtgggagactgtgatcgattcagctcgtttgagtgggatcgaacgaatgacccacttgttccatccggacaagggacccaagtcttgatagttgaaagtcttggaagctcgcatacgtgcacgaatgattgctgcagctgggactatagctgtgacagcgttgccactgagcatttcttggtttgcatatggctgaccgttgttcttaaagaacataatgggattcttgtggccaaatccttcaatcagaattagggatttctctgttggagtgatgactctcaagctggagagcggtttgtctaaaggcaaacggtattcggcgaaacctccgtaggaccagtcctgttcgggacgaactttaatggagtttccgtcataaatcactgtccattctggtgctggaatctgaagtgctgcagttttagagatcgctgggaaaacaagactgagttcaaaactctgtggatccagatagagatgcggaggttccaggttttccaggcttgctggtgctgctttcgtcttttcggcaatttgttcagcttcgccgctcagacactccagaagaaatttgaaagacaattccggcagcccatgagtacctacgaaggcttctacttcattgaggtctttgaggtcgcggtaccaattggttagttcatagactctggcgatgaagtcgacggaacgcgcagggatgtgggtgactaattgcttgagcgactccgtggttaataggttgtccccggaggagaagacactcttcgcatatgatgcaaagtcctcaccagaatcccatccttggttttctgctcgagtgtgatcgataaatttgaccaaggcgagcatgtcttttgcagaaaggccactgtgaagttggatgagtccgacatattcgcgtcgattgaggtcagcgagagaaaaagtttctaggccatttttgcggatgctattaactagttctttacggatcgcgtcgtatacatgctctggaactgacacctgagtgcgtttccagaacgcaggccagaaaccttcttgagcatcgagcatggcggttccagaaagcgctgccaggaagacgagtggatattctataaacagatctttaagaatcgctggcttggattgatttccgccaactgcttccaccaagattgcaatgatcgtttcgtattcttcaacggtcagctgaaaatccagcgcaaggagtggggtagggcgcgtgattttctttccatcattgccaataccactgatgcgagcttgcaatttggcgtttgtaaaccgcagttgatcattgagagttttgagatcttgaagatcgtcagcgaaactgcgctcttgtttgagtcggcgagagatagtcacggaatgaggcctttgaacggaagaatcggatcaaataattaagtttctcgttactgtagcgactctggtggacacgagatatgcgaatgggaacaattgtgtgacatatcgcttagaaattcttcattgcgccaagacaggcgggcgcatccatcgcatccaggttcgattgcttttcgacgtttacctccgtcaggttgcacatcctaattagtagtaaccgaaatttgcctagatacggtgggttgtcttctcattggttgcaatctggtttaaacgctcaatatcagccagtccggtcacaattactgcagagccacccactgcgagtggttctaaaacctggtgattgaaggactcgatatctgaccaaccagttgcaagaactctggcgccaaccggaacatcagaatgctggatgatttccggcaatgtgcgggtaggctggaagaattgatcgccataaaaacgcactgtggggccaaaatcgatggcaccattaggcagttcaccgccaccttcaacaactccacgaccaaaaggatcctcgctgacaatcagcacatcactatggcccttgtagtgggaaaatctatcgagggaggtaaagatggcatctgcctcgggatcatcaaaagagacctcaacactagttgctaaagcgccgagcataatcattgcggcctgccagctcaccggcaaatcaatagtgatgagcgagccttcctccagatccaattcctcaaggagcatattgccaaccttggacgcccagttatcaagagtgatggcggagaaatccaaacgcgcacccgtggactcgttataaacagtcaaacgaggggaggcaggatcaagagcaagcaagtgggagagaagttccataactccaagcctaaataaaagctagagattgtgcttaaaggggagtccggtggtcaaagtttgaccaccgactacggctattagctatccaattcctctaaacgctgcagtaattcccttaagcggcctgacctgagctcttcgagcaaatagtcatcacccatcatggatgcgatattaaagtgttgagtgagtacagcaaggatgtgctctgcgcttagttgttcaatcacattttgtttgaggaattctggaacaggtaggccccctagggctgcttgaggattctccgggctaaaggctgtcagttgttccttgagctttgagaggagaggaataacctctgtatccgccccctcgagattctcagcttcttctaactgtgggatgaatttagtcaaatcggaatatttcttttctacctctacctcgagttcatcatctcggggttctacatcatttgccagtggtcgaagggtgaaaaccaatgcttcctgctctagccccagttgagtaaaaactctgcggaggaagccaatctttacactcgtactagagccagtgtctacaaaaagcccgtggtcaatttcacggagactgctgttactgttgtttgaagttgccaggcagatttcttcattggtcaaagctatgagttcctggcggaaggattggttcaagacttttagaacgctctggagcatgtctgcccaggacgttaccgtttccttgtagtcctcatattcaaaggcgacaatttcgcgtccgcggaaagaaagatcactatctaaggattctgtaggaagcacagcttgtggtggctggaaggtttcttttggaaggggccagtagtccagcgctgcttgagtgagcagctcggttcgctcaattagctgttcttcagaccaatgcttctgctttttgatgaaattattgatgcgatagggggataccaaaaatccattttccatcgtccgcttgcgctcataggaagaatttgaataggcggagttgtagccggtgatggtgaggttaccaattctattaatccaagtctcatgaattcgagcatattcagggccgagttcagctctccactgatcgtttaggctacgtggcatgatgtgttcaatggagagagatccttcatccagacttgtttggatgtcacgaacatcattggaatcggcattttctagacaatcaaataagtaacgcctgttttcgttatgaatattccagaaatttttggttgcgaagttctcacggaattcactgtcggagggaaaacgcccggaaccatcgcgacgtttcagaatgtaggccagcagtgagctataactttgccctggagtccagaatttcttgatgtcgctataagcagtggagaagatcttgcttaaggcgttactagcaaccccgactgcaaaacggcggaataaataggattccagaacttttagaactccgaggaagtctgattcggtgatgatgccgtctttagcatctttgagaacaggcagcagaaaaggcaaaaccacatcgcccatgacagggacaaaacgcttaagacacctatcggcagctataaacccagtagtggcacctaagagatctcggtacagcttcgcgtactcgtacatatcgtcgaggatgaattcgaccgggagcttggagttacggatgaatttcttgaattcctcataaacatcttgctttcttggggtgcgcgcggttttgagagttaagtaccagcgaatgaaattgtcggtatcaaatttcacgcagacttcaatgggattccaacgctgctcatagagcttttcttgggttttgagctcctgatccataagaaccaagttgcgtaccttatcagcttcactgagctctaatcccgtggagttgagactttcaaagattcgctgcggatcatcaaattcctcaaggtcaagatacatgaccctgagtttctcgatagcttcccatagttgagctgcggtgagatcggttgccttaaggacattgcggaagtagcgataattagcagtgaggtttgaggactctatgaattcagattctgggccgaagagcttttgataagcctcattatcgtttttaactggcttgagcttgaacttgaggtttccctcattgccggatcggaggtagtcatcctcaatcaatgtggctagatcaatgttgtagccagcattaaactcaccttcttcaacttcagatgcgcgcaaggaatgtaccagcgcaagcatgaacaagctgattgttgtaagacgctgctgtccatcgatgacaacccaggtccagctgccttgaggcttaccaaccacagctccaaaaaaatgttgacggtggttttctttgaccacttcgctgaggtcatcaaagaggcgtgaacattgcttttcagtccagtcgtaattgcgttgataaaccgggatttccaaggttcggtgcttgccgtcataaaccttggttattttttgaacgtcaccacgcattggatattcacccttagaattgagaagaattttctttaaaaatacagtgtatgcgcagaggccgacaccgttcggaaatactttcgaactttagttacttggtgctctaaacccgcggcagcaactccgaaggctcagtatgcgtggtgagaacaagggcatcacgtgcacgagaagctgcaacgtagagcaaggagcgttcgcgctgttgggcgtcgttacgctcggcctcgcctaaaccttgcatggtgtattgcaaaggaatgaggtcacggcccattccgatcaagatgacatgggtaaactccatgcctttagctccgtgcattgtcattacactgacagtttcgtgggctgcaagttcggcattttgcgtcttgacggcatcgatgccctgctcagagagcgcattaaccacgcggttgatcaaaggacgggtgcgtgccaaaatgccgatgcgtacatcggtggtcctgtcctgccacaccttgatgagctcagcgattgcttcgaactcgtcggtctcagattcaaattggtagaggtgtggcttggggcccttacgcgctgagcgatagtgctcaattgtgtccgtttcgccttcggcgtcggtccattcaccggtgagcatgccaagtgcgtaactgaggttttcggcggtggtgcggtagttaagggtgagtcgcttagacgcccgaccgcgggtggaaataccaaaacggcttagcacatgatgttggccgtagatgcgctggtgtgaatcctcagccaagaagatgtcattgggaccttcggctaccgcagccctgagtaagagccaatgtccggcgtggaagtcctgggcctcgtcgataagcacatggtcaaatagccggccctggccggcggcggcgcgctgctccaggatgtttgcggcgatggaggaaagcgctggccaggacatctttccttcgcgcgcacaggaagtcatgaattgctgaataatcgcccacacttttttgcgttgtacgcggtttagtggggtaccacggccgggacgaggtgcacgcagatagtccttttcttgggtgattccgcgggctaggattacggtttcaaactcttgggcgaggaattcagtattgctgatttcttctgatagatcgccgggatctgcggaaatgatcgcgtcgatccaaaattcttgttcgccgttgccgatgaatggggtgattctgccggctgcacgccccaagatagcagtggttgctgcctcacgttcggcggtgtttgctagcgcaaccaccttatttgccaaggcatcaattccgctgatccacaagccaggactaccgggtttttctgcctcggggaaagtgggattaagcgcgttcatggaggatttcaacgcatcggccaaaccgcgggtataggtggtgagcaggactcgaggcgtcttatcgtcggtctcaaggtgtccatcagaagtgaccaggcggttggcacggtggactaccaccacggttttgccggtgccagctccaccaaaaacgcgacccgatccgctgaagttgcgggtgactaaggagcgctggctggggtcgatatacacgcgccagctatcaaaaccttcagtttcaataacgcggcgcaggtcattgctatttggggtatccaaataggcaaagtccatttgcgctgctggggttttaagcccagcaatgagcctggtatcttcgctgcgggtatccggctctgtggaaggtgcggggatagcgagcgattcgcggatatcttcaatgctcaaaccggcgacaaggccgataagtgcgtctttttcccacgtcgggctgctaggaagcgctgctgcgatgtcatcctctgaggcaagttccaacacaatacgggtggcagccgggtcaatgccgagctcggcttccaggacttctggggtgtgccctgcatgtgcgagcgcctcaccagggctgggcagctccactggggtgggtacttcgacggcgtcccggagttgctcctccgcccgctttgcggcctcttccgctttgcgacgagattcctgatcgtctttttgcgcaggaacggtagtttcctcgatgagtcgagtaatgccgttaacagagttgacttcaaggcggatttttcctgccttggtgatggcatcatcatggggataaacaccaaccactacaaagtgatgatcaaattcgtcgtgaagctcaaaaagcactgcgcggaattgatcattgacccgacctgtgcggacgcgggagtcgatgctgtttttgatgggctcaatatgaagccccggggaagctggattggtggctagtttattgaggaaatcgagggtgagttttttgaggctgccgtcgatatctagtgcgccgtgcacgctataagaaaccatgatttttatctttcataaactttgggtgtactagggacgaagggcagcgggaatatcggaggtctcgaggtcatttgcaaaaagcagcgtccaaccttcagctttgagatcatcctccaaaggctcatcgggatcagattcatagagcaaagcgatcttgacactcggccacgtagcaatcgtaggaatactcgagagctcatcaccggtggtctctggaaccagggcatgttccttagccaagatctgcaaagcgccttcggcttcttcatcttcatcggcggtaaagccatccaagatgggagcccacaattcaggaacttcaacagcaagcggagctgctggagcaggcacaatatcaattttatgcggtgaaccattagtgcttacgtctacggattccggtgccagccacatgaggttggccaaattgaggaaggcagtccaggtatccacttccagctcttctggagtggtgggagcaagccacaattggcgggcgcgcagttcccgattaaccatggtggcccgcaaggaaatcttattgcggaaggtaccaacaattccgtcgccatttttttgtggattatgcccaagcatgtgagcagcagcgatatgagcaaactccttccacgaggatgccgcgggattatctaaaaatgccaagagttgatccataggcgttgctgccaggagtgcagttgattgtggatcaagaatcaaatttgctttgctgagctgcctgccgatggggctaaaccatgctggttcctcaccttgtgcagcgggattactaaagcggtcgaggtctaagctagtgatattccacggcaaaatattgtctggatcgagcgctagtttcatccgtttctgaatatcgccatcaagacggtagttagctgaagagatatggaacgcagcgccatcggtaaaaacagccacggtgggatagttgccgttgagcggttcaaaccagaaatcagggcgtgtatatccacgatcaacttgttcgctcatccgccagcgcacaccggagctcatctcaatatccacataagagtttgagccgttgacgcggtccacaagtttggcatggcgattttttaaggcgcgtcgcagcatcacgcggaaacgcagttccaactgagagccaagagtgttctctgggcgcttttccaagaaagtccagtccggtactgcagaaaggtcagtgatttcttcggggcgcgagctattgagcaaaattgcgcgcaaggctttttctgcagctgcgcgggaagtctggaggagcgtggcagtgcgggtataaggcaacaaacattctgggcaggccagcctttcatcatactggcattggcacctagacacccgctcccaagctcgggaaataagttcacgaacctttgtaggatcggcaaattggttaagataacccgtgcctcctggaacctgatcgtgcagcaaaagggcatcaagtgcaccatcgccagaagtacgggggacctgcacactggtgacatccaggtggtcaggatcgccacccaacacctcacgaaatcctaatttgatagcagcaatgaggctggttaccaccatagaatcggcttcactgccaaaatattcgggcagcagcatgagcacgccttgggttttaagagtacgacccaaagcgaaagatacggtatcttctttttgctcataacggtgtgggcaccagggtcggtgatcccagcgtgagttagctcctgcctcggaatctaaatgtccacagtggcggcacacattaaatagtgggctggtgacttcaaagccaccgagccgacgcttttggccattgccaattcctaagttcagccagcgtaattccaccttgggcagatgctcaatgccaaaaccatcattcaaataccaggattttccatggccatctggtggaacgacaaagctgacgtgctggttaaagcgggtgctaaagcgatcttcacggtcatcgctaatggcagcgcgagttttctccactgcggaggaaaccttacgcatttgcactacctctaggatttgtcccttatcggcaaaggcgggggagccacaggtaggacacgatcccggtgtagagacacccggctggaggatttcggagtgcgagcacacggggcacaaccgccattgctcaatggcagagccatgttcaccaatctcaatggaatcaactttggcagcaattccttgggcataaaaggtcgcaccgggagcgagctcaaaaagcgctgcagagatcccacgcgagtaggcatgattcttggtatcaaattccacttcctgggggttgaacgaagtaaccgccacattaagttctacggaatcatcaaccagggtgaagttgggcaggagaccataacgctccaaagcagcgatccagaattcaccaagtagatcacggatttgaagtttgacggctttaagggaagctgcggttttacgtttttcttcctttagctcttcatcatgtgcatcattgcgcgcatctagtttgtcaaagattttttcgagttctccccgccgcgcggtaaggctgcggcgttcttccatccactctttttgggaggtttccagcagcgcgaggagggagtctgtgctatttccagatgcccaagtgcgcagttcgaaaatattatcaatgctgatttgcatgttgagggtgcgtacaaattcctccagcaaaggatctaggcctgcgtgaatctgcgctttgagtaatgcaaccaaaggtgtttttccggcggcattatcaaaaacatcaattgctgtttcgagttttggcagttcggcgcgagtatctaagcagtcgatcacatatgccaagaattggcggtgcaagatttcactggcggaaagatacgcaactggtggggtaatagctcccttgatcatggagagcggttggttaagacgaggcaatgtgacaccgcggccacgcaccacggcgagtaccaacgagtttccgctgaggcgcccggcacgaccaacacgctgtacataactggccactgatgttggcaaagacgcaagcatcacggtggagagatcgccgatgtcaatacccatttccagcgttggcgtagctaccaacacattgggcgcatcgggggattgtttggccgagccttctccacctctaaaggattgttcgagtgcgaggcggtcttttttcttgagcatgctggtgtgctcgcgggcaatgacagtgcgcggttcaattgcggaataaagcctgcggtagtagttgtcttctacttcctcggtatggagaacgcccccacaactagggctaaaacacggagcgccatcaagaagttcacgcacatgatcagttacaccagtttgggcatggcacacgctgcattccagaacttcgggatggtcttcgctaaaaatacggatgcgttcggcctcgaggcagtagatttttccgccgctgtcggtagatattgaggagagaatgctgcggttgcttaaagcgtcgaaaagctttgtgatggcggtggcggcatcgtgggtgctgatgccaagcacctgcgaggtccaggacgcataacgtccgcgcgggctaccaagcggggtggtgccggtgctggaacgcagggatccggaaagtgcggaacctacacgtgggaattcaggtgcaccaccgcggacaaaaccgggaatgccctcagcgcgggcttggcggcggttaagcatataggggttgccatcggtgcgcaggtaggcgccaaaccactcatggttgatgcccccgcgggcgcgcaaaagttccagggcaccttgcacccagcgcagtcgcaggttctcatcctcaatatctaaggtgggaacttcgatggcataaagtgcttcggcagccgcggacaatgcaacacctttgggcaaatccacaaaagcactcaaagcgccggtcagcgcaagggaacggggtagatcagcgcgttgtccaaactcgagggcgagatcaaaacttaaacgtttatgcacattgcgggaggcctcacggcgctcagccttgctggcatcggggtgccaataaggtttgtaaatatcaagatcggtcaggtcagggggtaggagctcataacgggtgcgcccagaggtggcgttatccatcagcgcccgggagattgatggcaaggtgacttcattatcacccactgcgcgccgggtataggtacgaagggcaaaagcgcgggaacgtgcttggacgtacccggcgcggtgcgcggcatcttgcacggaatcggcaaagaccagcgtctttttctcagcgctatccaaatcggccataccaaaaagattggagagtgagacagagagcagggtagagattcccgatccgatataacggatggaatcaacatcaccacaggaagggcaggtctgtttggcggagagatcgtctgcctcagggccaaagtgggtgagcactgcgatagaagaacctgattgttcttcttctgggctgggttggcgcgtgctgagttcattgctggcgctatggaaccacagcactgctgaggtgccatcaactcctcgcggcccagcaacgctgcgcccctgctcaatggctgcgcgctgctcagaggtggcgtcgagaagcgctctttgtttatggggttgttcaaaggagttgaggcgaattttttgttcttccaacaccgggatattggtgccttgttccaggctgaccatccagccggaacggccacaactgcggcaataacacgccggcaaccattgttgggtattggcatcttctgccgggccatcatcggaccagcgaaacatggattgttcatccccaacccccagggcgcggtcaatgcgggagacctcgcgcacccaaagatgcgtttcgacgccaggtaggcgcttggcaccccaggcggcaactttgccgtattccgcgcgcacaaatgccatggcagccagtgcatggctgataaattccgcagctttaacctcacctaagatgcgggcggtagcccccaataccagctccggaagggcagtgacctcatcttgatcacgcctgctaagcggggtggaatcagcagcatgctgcaaaatcgcagcagttaaatcatgagccgcataagcactgatcgctgcgtgcagatcagcctcacacagccacactttctcacaaaaaacgcggaagcagagctgtgcataatcgtcctcatgttgagctgtggcgatggtatctaaaaccacctcaatatcttccacagtgggtagctcacggggctcgctaactgctggggcaccaaaattctgggcaatttctgcgcgccattgatccagctccaggcgagtttccccgacgatggcatcagctggaaaacgctcaccaaaaatggtgtaagcaaaatccaacatgggggagccggaatcaccagaacccaaggttgctgaggtagccactggcgtaataatgcccaatggccggtgcatggcactatcatccaaaaaattagcaggctgctgggatttcagcatgagccccaaacgccgcaacaacaacgccacatctgtaccttgagcaccgtcataagtgtggaactcatcaagtactaaatactgcaaagaggtggcggatttttgccacatttcgcggtcgacgctgcgcagcaagagctgatccaacattttgtagttggtgagcaaaatatctgggggactaacccgcatggcttggggatcattaataagctccctttcgcccatctgcgtgcgattgcccttggcttcaccggtataaataccggcggtaacacctttaagtgctgggttattgtgaatgagccgcgccaaacgatctgcctggtcattggccaaggcgttcatgggataaagcaacagcgccttgatgccttgttggccacgtttccgcaggcgcagggcatgatccagaatcgggtagaggaaagattccgtcttaccggaacccgttccagttaccaccaaggtgggatcggggcggcgatctttacctcggttatcgagggaactcagccgctgaaacgccgctttttgatggtgatagggcacaaagttctcaggtaaccaactcagcacattttcccattcctgtgcctgagcatagggcaaacgtgcacgcacataaggcccgtggaacatgccggaatcaccgtggcccaagaaccgcttgagctcggtggccacttgcttatccgcaagggaaaaactggtggtcaaatattcggtgatgccttcttgaatgctgccagccgcatggacaggaatgagtgaggacataagcgctctatggctcctttagctggttttcaaattttgcatatgcagcacgcagatcagcttcacgatccaacacccggaaaggatattcaaaggtataggacacttctgattggggatgcacccaggtgcgcttttccacgctgagctcttggccatctttaagtttctgctgcagcttgatgatctctttaggaactttacggccattggcatcaaaatgatcttcttgatcatatctacgcatcactgggaattgagtgcgataaatcatgcacagctcatcagcactaatacccaaagacaatgccaccatggcatcaatatcgttttgcgctgctcgacgttgctcggcattgcgcaaaggcacctgaacatcccacggctcaccggtgatctcttcccacaatggggcataagctgaggtcaggcagttgaggcggaggtatgtgcgggcgaactgcttttccaaggatgtgaaatttggaagtggaatcttgcgaacaatgtcgttaaatatgtggcttgaacccgaggaccgagcaaaatagtcacttagaattgcaccaagctgtgctccaacgagaatggtttttaagtttgaacgtgatgcagcgctattaactgtgtgcacatggttggctcccggtggaattactgatgggtagacagtcctaaatcccgtggtggcagccatctccctccatgcaattcggaaagtgtctgcaactggtacctgcttgtccccgaaagtccaggtgccgtagtcagcatcataagtgggctttgtttggcgatcgggctggtacgccgttgcaggtatgaagtttgcaggaatggcctcgaaatcaatttcagaccaatcttgattatgcttcattgtcggattgggctgcttgatcattggtgtagcaacacccaggtgcggcccctgcaaaatggcatcagaccaggaagctgggtagccccaaccaacgtcaaagtatccctttttcttatcggtggtttcattccagccactggagaactgcagcccgagttctttgatacgaggtgcagaagccaacttttccaacactgctgctgcttccgtgttgacggtataaaccatgcgggtatccaagtatggcgtttgttcatcctccaggatggacttccacaccgtcaaagtatcggcattgaccagttggatacggtccttgtgtgggcgacggtcccagttgccattgtcgtctttaagaccagggagattacctgaaccgtcatgatcaagtgaatcaagcactgtttgtgggtgataaagcgacgcagcacttaaaaagttaatagattcctgcggagcgccatagacatgtacgccatatttaaccaagtcgtggacgtcaaaaagaatcaactcattaatgaactgccagtggcggcgcagacgctcatatgctccccgacgtagcggggcagcttttttctcagtgaagtgggattcggggtggatcagtgagatcgcacctgccggggaggcattagaccaagtcttttccataaagccccggtagaggtccgggcgttgatctttaagatgcggatagagagtaaccgaaccgaggatcgcagaagtagccacggtttcacctgcaccactgaccacatgttcgaggctcttaggattgttgtgaaaattcttctggcgttcttttttggatgcctgggttggtttactcattacagcccaccacggatcatgttcagcaagcagatcctcaaagttcacatctggtcgcacccatggtggattaccaacctgcagatcaaatccacccttggcaaaaacgtgggcgaagtctagatcccagtggaagaagctctgttgtttagccacttggcgggcaacattgatccacgggtgattcgcgctaacacgctcaaagctcaatgccccagaaaaaccaagatcagtagcctcggcatcattaatggctagccaattggtatctggacctaagacaatctgattttcgtttttggacttcagagggagatcaatacccagaatctccgtcagggtggctagccactcatcaagatctggaagggctggacgctccggatgctcagcggtagcaacagcatccaaaggccagaaccacagcgcacaccaagcatccatcaccaagcgtagacggttatatgcaccatcaatattgccaaagaggtcttgttcaatttgctcacgtgtgacaacctccgaaacctcagctggctcttgaccccagagagtagtgctacgtgagatctgggattctgcaatgcgaatacgcatcagcacaaatcgccatagtgtttccacgcgtagggcaaggttattgagctgcttaatctgagttttactcaaagacgcacggatggaagtacgccaagatttaagctccttgatttcagtagccataagatctttaagatctttggcatctgcagtggctccccagccagtagagggcaagaggaagtggtggatgccgtggttgaagaggggttctgctttgttttcatcaatagcctgcgcgatatcatcaagccgatagcgggttggagtagcagttaaccaggcttttttattaagcagactaggtgcatacagcgaacgggtggcaccaacgagggagttaccattacgcaggtgcaggccataccaaggtgcgtccatttctgcattcatggtgtctagccacagcgagatttccgccaactccacagcagtgctgttaaggtccacaccataaacctggtgcagcgcaatgtgcgctttgaccttttggagttccttggcacggtcttccgctggaatctgctgctctagttcttcttggcgcaattccaaataaagctctgctaattggcgtactgcttccacagcgaaggcgccggaacccatggcaggttcacagatggtgaggctgagaacatcattggctgtggtgatgcgctttgatgcctggagttcttcaatagcctgggtgacagtaaagctggtgagtacttgtggggtgtagaaggacgctgagcgttcgcggtcacgagaggactgacggaacacaaatgatccgcgcgggtggcgtttacgcaccttgattacgccgccaccaggggcttcttgatcaacttcgataaagctatcggcagggacttcatcagcctttgagaccgggagcatccaggaacctttatcggctttgccatgtggtgcaacctcaaaaagatcttcctgggcgataaagccggtataggacatcagaccctcataaacttggccaagctcggtaacacccaaggtggcataggagataaagccgcggtctttaccggattgcacccgggagagcaggaggttttccaagaccttgtttagggcttcattggaaagaccaactcgatcaataagttctgtggctgcagggaggaagagatccgctgaaaggttgcggaagtgcaggccttcttctccagcctcggcatcaaaagctacagccttagcatctgttgggtggtggcctttatccaccagagtgaacagcagctgcagggaatcataaaggtgggtgcccgtgcgagcatgctgggtaactgggggattaagaataagctcgcgcaggcgtgccaagccataaccctcgtcatattccggggtgccggttggcaggatttcaagctctggtgaagcctcggcaaaaagcaggaacaaaatgcggtagagatagcgcaaagattgcttagctagctcgccaccgtcgatctcagcggtggagagctctttagcttcatagcgtgtgagcacgtcattgcccaggatttcaatggattcacgcaccgcactgcgtagctcgccagaaaccttgacagcatgttcgcgggattgctcaatggtttcttcccaccaggtggtgccatcggcggcacgctcggtattttcgcgggctagtgctacgaccgtctgctgcatctcaccctgggctttggtgtcattacgttccaccaccagggaaatatcaatagctaggtggcggcctagaggccaggtttcacgctcggctaaaaccacccatttaccagcggtgataacaacaaaagcagggggagtatcactaaggaaaatctggcccaccaatttggctgcggtgatatcctggggcttgtcattgaccgctactggctcaaggggaagggatcggaagttctcttcaaagctttcagcgggagtcgctgcaagaaattccacactgccggcatttcccacccaagaggaataggatattgtgtcggagccgcgctgcgcgtggcgcgcgctggggacaccataccccagtgcagaggccactaaactggcggcggtggtggcgtcgtcaagctcagaaagagcatgctgcaactgcaggcggttgctggaaaaacgagttaaagggccactctgctgggttgcgtcctcggtggttttccattctttaatgcgctcgcgcacccgcttggaaaatgaggcacctttggcatcgtcattggtgaggtagtggtcactgatccactcttcaacatttaggatcgaatcaaatgcactcattgtgttaaacctcggtgttcaaagttgcgggctgcggaagaatgacggccaaaggcctaataagttcacggtctggctcgagagcattactcaatttctgctgctcctcaatcaattttgcagttcgcgcggtacgggacgtggacgctgcgccacttcgtttgttattccaggcttcggctcgcttagcccaatgctcaacgcgagtttgagcctgagcgcgggcggcgatcattaatggacggatctcgccgcgggcggcctgaacagcaagggaaataagctgctcaatatcgtcggggagtgcagcggtacctgggttaatggcggtttcatcgaggcctatggaatgtaaccattggatgggatcggacagcacctcagtatcaaaggggccagaagaagccacaaaagaacgagacacaatttggccacgccgattgctcaatgtggacataagcagcaccgttggctctgtgactttgccactagccgccggaatttccgaacgtggcatggttgccagcgcgcggtcagctgcccacgaagtgactgggtgcagggggcctagatagtgggcacttggccaggtactgccatcttcaccagtgcgcgcagcgttgaggcgttcttggccacgcatcagtgtggaagctagtaggagatcttccttaactttccgggcagccacataatcctgcgggaggaaatctagacgacggcgcagatcatcggtgggggtgagctccacgatgtcattatcgtgttttttgaaccccacgccaccgcggttgatggaatcctccggtacgttattgaaaccttcgaggaggcagtcatagaggaaagagctttcctgtgcatacaaccggcgttgtgcatgctgcgtgctattggaagctgcatctggtgctgtttggttttctgtttctgcttctgcttctgtttctgccttggcatcggcttgggcgatttgggctagcaaccaatcaatatcatctaggcctgctgggttttctaggacttccgctggatcagccactgcatcattaaagttttgggcaccgcgcaggacttcgcggatggtttcttcttccaaacgctcagagtgcttgcccatgagagatgcggcatcaccgagcaaagagtgcgcctcatgttcgcgctccatgagcctctccagcacatggacttcacctactttggaatcctcggcgggatcgagcaagaaggtaacgatggaagggttgtgggtttgaccataacgatcaatacggccattgcgctgctgaatgcggatcagtgaccacgggatgtcatagtgcaccaagttgtggcagagagtatgcaggttcacaccttctgaggcaacatcgccggtgatcatgatgcggatgggagaatccgtctttttaaactcatccaccaggcgcatttgctcctggtcggggagaccgccgtgcataacagcaatagagttgggtggcatcttgagatcacggatgaggttttcctgcagccagtgcaaagtagcgacacgctcagagaaaatcaccacgcgggtatcggagttcttcttcactccgatgtcaccgaggtagctcagtagagattggtacttctgtgaggtctgcggggtgatcgcagaattaagttgtgaaagggtttctagggcgcgtttttcttctggtgcagaggcctttttgaggcgattggacactgtttcgcccaaggctgcaggggaggagagaaaagccttcaccaatgtccaggggaagaggcgatccttgatcggattgctcgcacctggtgaaatccacacatggttgagttctgcagcaacgccgttttcttcttttgacgcagcgaccaggaagttctgaggctcattgcgtggagcccatttttcgcccacaaaacctgaaacctcagggctattgcgatggcgacgaatgatcagacgctgtgcagcttcggcatcaatggtgccatcaggcatcacagcggtgggatcaagcaaacgcaagatctccttaaaggattctggatcaccattgtgcggggtggcagaggccaaaataagagcctcggcagtaggcgcaagtgtgcgggctagctcattattttgggtgccagcattggttgcattgtggatttcatctataaccaccgcatcccagtgcaccttttctagttgcgcgcggtacttcggagatttcaaagtatccatagagacaatcacgcgcgggaaataagtaaaagggttgcgtgatgctggcaatttttggcgcacttgctggatgcccacggaatctagacgaacgagcgggatggcaaaacgggtccacatttcctgctggaactgctccataatgtggcgcggggtgactaccaaaatgcgctcaccacggccacggcggataagttccgccaagatcatgcccatttctagggttttgccaagtcccacggcatcagcaataagcacgcgggggcgcaagttagcactagagagggttttgcgcacggctgctaattggtactccagtggatcggcgagcatttgatctgccacggaaagtgactcttgatagagcggtaccggagttttacgcatggtggcctccaaccacaggcgggtgcgacggtaattggaggaatcatcaagactgacggtgacctgggtagggtcaatgaccttcaaatctttatcaagtgcggtgaagaacgtagcttcgtggtcccgcacataatcagagagaccacgagctttaaccctaaaaccatctgtggagcgagtaacgtgagtaaccagccaaatttcatctcggacttcaatggtgacacccggggatagagagtcagtagaacttagcgcacctgattcagacataggttaaagattaacgcgtcttaacaaagtatttgcgaatacggtccactttgtggcaaaaacgccacaccccgcagcccacggtggtgggctgcggggaggcgtcgaaaagcggggttttagttaacgcaacggggaccgtcgccaccagcatcgaactcggggctttcaatcggttcaccgacgtccgcaccgggctggccgacggtgctggatgtcacggcgtttgcttccgcggtagggccagcgtaatcgccggcggatacgacgatgacggtgttgtcgtcgagggaagagttggccacgatggggaggccgccgagggcttcggaaatcgcgagggccttggcgctgtcttcttcggcggcgaggatctgggactcgtagtagaggccttccgctgcgttgccggtctctgcgatggagtaacccaattcctgcagttgcgcggcgataccgttggcgaggccttcgacgtaggaagcgttgaggacgtggacctcgacttcgcttaggtcaggggcctgatcagcagattgatcgtcggagccgtcttctggagctggctctgcttcgccgagtgcttcttggaagaatgcatgcacctggttgacatcgatggtgacaacggactcgccgtaatcgccggtgccgtcgatagaggtaaccgggatggtggcaaatgtgacgttgccgcccgcgaggttctgcagctgagtggcaaagctcatgatctcccagccttcgtcgatgacgacggagcgggtgacggcatcagcaagtgcggaaagctttgcagggttggtgagtgttccagaagacagcacctgattaacaagcgatgccatatacgactgctggcggacgatgcggtcgaggtcgccgcgggggagatcgtggcgctggcgcacataagacaacgcatcggagccaccgagggtttgacggcctgcagggaagttggcgccggataaaggctcatcgacggcgttgttgaggcagacttcgacaccaccgacagcatcggtgagcaggacgaatcccaaaaggccaacttcggcgtagtgatcgacggtgatgccggtgagatctgacacagcatcgatcaaaccttctcggccagcatccttcgcccgggtttccagctctgactcattggtgaaaccctgttccatgagctcagcgcgacgggcatccttgtacgcaccgtaaacgccgttgatcttcatgttgccgtaatcgtcatcatgaatataggtatcgcgaggaatcgacacagcggtggcagaggaaccatcgttaggaacacgaatcaccatgatcgtatcggtgttgtcgttctcctcgtcgcctgcgcggagcatcgccagctcctcctcagtcagcgtgttgccctgagcatcggaacgggaatcagaacccaccaacaaaatatcggtagcaccgtcagcagcattgccgtcctggatgccgcgaccgccaccaaggttcaagttgccagaagcgacaccatccacttttccgacagcaagataccccaaacccgataccaacaacaccagcactgaaacaaaagcgacaacgcttcggaacacaggatggcccgcttgtttagttgattgcattgctgccggagcaggcttaatgtcacggacgggacgatacttttcagtcacgtgctgctaacccttcgcggtaattagattgtcggtcaagttctgtatgtgttctgtatttatggagcgggggttttcatacgcggccattggctgcttggggcggccttggcgactttaggctgctgaactgtgctcaaaagcttgtgtgccggtgtcctctcggcaagcgagaagccccgatgaaattatgaaaaaccataggttctggacaattctaagccatatgagggtgttttcctcatcggttatcgggagtggcggatacttcttgcaaacttaaaccactatgctttcgcttcgtgagtactttgaaatcccccatcgctgtgatcacagtgacctattcaccaggtaaatacttggcgtcgttcctggattctttgcctggtgcgacttcacgagacacccacgttgtgatggcagacaatggttctgtggacggtgttcctgagcaggcagcagcctcacgcagcaacgtggagttcctctcaactggcggcaacttaggctacggaacggctattaatattgccgcccgatcgttgcgtgcgcgccgggaggcaggagagatcgatggggagttcttcctcgtctcaaaccctgatgttgtttttgacgaagactctattgatcaattgcttgaatgtgcgaaacgtcaccctgaagcaggagcggttggcccgttgatccgtgaggcggacggttcggcgtatccgtcggctcgggcggtacccactttggcgaatggcattggtcacgctttgttgggtgctgtgtggaaatccaatccgtggtcggcggcttaccgtgacgatgaagatatggacactgagcgcactgctggctggctgtcgggatcgtgcctgttattaaggtgggatgcgtttgatcgagttggtggttttgatgagcgctacttcatgtacatggaagacgttgacctgggagatcggctggttcgcgccggtttcaccaacgtcttttgcccaagtgcgcagatcatccacgcgaaaggtcatgttgcgggtaaaaacccagagaacatgttgcccgcacaccacgagagcgcgtatcgcttccaggctgatcgcctcgcgaagccgtggcaagccccaattcggttggctctgcgaattggtttgaaattacgagccggagtcgcggttggtgtctctaagatgagaacgaaagcctcttagaccgtcgacgaccaccggacggtgaattcaactcatttcaggcaaatgtaaagtgaatctacattaattttctgaaatggatttgctgcggccccggaattacccttttcgcggccgtcatcaaatttgtacccccttaaagacaccctaaacacgagtgaaataggaacacatgactttaactgacaacagcaaaaacgttgatgctgtcatcttggtcggtggcaaaggtacccgactgcgccccctgaccgtcaatactccaaagccaatgctgccaactgctggccacccattcttgacccaccttttggcccgcatcaaggccgcaggcatcacacacgtcgtgctgggaacgtcattcaaagctgaagtcttcgaggaatacttcggagatggctccgaaatgggcttggaaattgaatatgtcgtcgaggatcagcctttgggcactggtggtggcatccgaaacgtctacgacaagctgcgtcacgatactgcgattgtgttcaacggcgatgtgctctccggtgcggatctcaacagcattctggacacccaccgcgaaaaggacgcagatctgaccatgcatctcgtgcgcgtagctaaccctcgtgcgtttggttgcgtccccaccgatgaggatggtcgcgtcagcgaattccttgaaaagaccgaagatccaccaaccgatcagatcaacgccggctgctacgtgttcaagaaggaactcatcgagcagatcccggcaggccgagcagtttccgtcgagcgcgaaaccttccctcagctgttggaagaaggcaagcgagtcttcggccacgtcgacgcttcctactggcgcgacatgggcaccccaagcgacttcgtccgcggctcggctgacctggtccgcggcattgcgtactccccattgctcgaaggcaaaacaggagagtcgcttgtcgacgcctccgccggcgttcgcgacggcgtcctgctgctcggcggaaccgtagtcggccgcggcactgagatcggtgccggctgccgcgttgacaacactgttattttcgacggcgtcaccattgaaccaggtgcggtcattgaaaattccatcatttcctcgggagcacgcatcggtgctaatgcgcacatctccggttgcatcattggcgagggcgcacaggttggtgctcggtgtgaactcaacgcagggatgcgcgtcttcccaggcgttgtgatcccagacagcggaattcgtttttcgtctgatcagtaggcatttttagcccttttggacgggcgttttcacagcgaccgttcgggggcgaaaatgtttttggttgagcggtttttggagattatgcagcactgcttatacttgtagggagtgctgatcttgtggcagaatctgtctaattaagattaatgacacaatatgtagtacccccggaaaatgcccccgcgagagggcttttgtgactggtgtgaatattgtgaattaaccggcggaagtttggctgattttttctgtaacggttgacggcgatgtaccagcacgtgtgtaatcgcttgggagaaggaaaaattttccaaacctgctcggggaccaacatccccgatgagaacagacttaaagtagctttgaaagtgagaggggggcgagtaatggaagattcagctggggacgtatctgcaaagttgaaagcaggccagactcgcaccgcactggagatgactttggatgatctgttcggagcggttgagcaagaatggcaggagcaggcgctgtgtgcgcaaactgatcctgaagcattctttccagaaaaaggtggctcaactcgcgaagccaagcggatctgccagggctgcccggttcgggatgaatgcctagagtttgctcttgagcatgatgaacgctttggaatttggggtggtctctctgaacgtgagcgccgccgcctgaaacgcgaaatttcgtaaaacttcaagaccagtaagcgaacctttaattaattgagggttcgcttttgttcttggctgcaccggcttctaaaagaccaaaaccggcgtgtttttagagctactttggtctcgatcgctactctgcaggcctgaatggggtggaactggaccaaaagtggcaatggctggaatcgttcttggtctcgattgttaacctccggtggagtgccattgaaactggcctggcgtcggagaagcccagaatcgtctcccaattgcccatggtgcaccggccacgctagagatcctggaatcccggatcgatgtctcgtggatcaatattcagatagttcgccaccaaagaggtgagaacatgagtcaatagctcgtggcgttccacagcgttggtgactcgttgctcgatcggcattctgaaaataacgatgcgcgctctcgtggggtttcccttggtatcgatcgccggtgggatgacgcgaccaagtggaacggggccgtcggcggtgatttcatcggggagaatggcaaggtcggcgctgagtcgcatgcgaggaacggtatcgacagcgatgtctagattgctgagctctttttggtaaatcccgtaaagaggggagtaggcctctaagactgcgcggtcgaaggcttggcgtctagaggcgtggcggggaacttcgacgggcatgagtgggccgcggagaccgcgtccgtgccgattgcggaaagttctcgtatgcatgaaaacaaattctatgtgtgttgagctgccaaaaggggttggcgcgccgatgatgactgtccaaacctaaaccaaaggtctaaactttggcttcgtgagtcagtttcgtcgttgttcccgccctggttgtggcaagcctgccgtcgcaaccctcacctacgcatattcggattccactgcggtggttggtcctttggcgcctgcagcagagccccatagttgggatctgtgtgagcatcatgccgagcgtattactgcgccccttggttgggagatgctgcgggtgaacgacatcaaagtcgatgacgatgaggatctgacggctcttgctcaggctgttcgtgaggctggacgcactgtgagtggtctggttcctgaagacgaagtgggcggcaaccatccggtgaaccggagtgcgcggatcgcggaacagaaggttcaccgcaggggtcatctctatgttgtgcctgatcaggacgaatcataaggtttgctattcggattggatcctttggcaggggtaggattgcaagcgttattttgttccctaaccccttcgaggatttatgcgtacccgtgaatctgtcacagctgtaattaaggcgtatgacgtccgtggtgttgttggtgtcgatattgatgctgatttcatttctgagactggcgctgcctttggtcggctcatgcgtagtgagggtgaaaccaccgttgctattggccatgacatgcgtgattcctcccctgaattggccaaggcgtttgccgatggcgtgactgcacagggtttggatgttgttcatttgggactgacttctactgatgagctgtactttgcgtccggaaccttgaagtgtgctggtgcgatgtttactgcgtcgcataaccccgctgagtacaacggcatcaagttgtgtcgtgcgggtgctcgtccggtcggtcaggattctggtttggccaacatcattgatgatctggttgagggtgttccagcgtttgatggtgagtcaggttcggtttctgagcaggatttgctgagcgcatatgccgagtacctcaatgagcttgttgatctgaagaacatccgcccgttgaaggttgctgtggatgcggcaaacggcatgggtgggttcactgtccctgaggtattcaagggtctgccacttgatgttgcgccactgtattttgagcttgacggcaatttccccaaccatgaggccaatcctctggagcctgccaacctggttgatttgcagaagtttaccgtagagaccggatctgatatcggtttggcgttcgacggcgatgcggatcgttgcttcgtggtcgatgagaagggccagccagtcagcccttcggcgatctgtgcgatcgtagcggagcgttacttggagaagcttccgggttccaccatcatccacaacctgattacctctaaggctgtgcctgaggtgattgctgaaaacggtggcactgcggtgcgtactcgcgtgggtcactccttcatcaaggcgaagatggcagagaccggtgcggcctttggtggcgagcactctgcgcactactacttcactgagttcttcaatgcggactccggcattttggctgcgatgcacgtgctggctgcgctgggaagccaggaccagccactcagtgagatgatggctaggtataaccggtacgttgcttcaggcgagttgaactcccgtttggctaatgcagaggcgcagcaagagcgcacccaggctgtgctcgatgcgttcgctgatcgcaccgagtccgtggacacccttgacggcgtgactgtggaactcaaggacacctccgcgtggttcaacgtgcgtgcgtccaacaccgagccgctgcttcgcctcaatgttgaagctgcatcgaaggaagaagtcgatgcgttggtagcggagattctagggattatccgcgcataatcccattttccggcgggcatcacgggaattccttatccttggtagtcaaagtcaaggaaaggacttcaatccccgtggtgcaagtggacaataccttttatgacggttctgcttatgatcctgaaaccgtccgattttttgatgtggcgcaggagggggcccaggttcgccagatcggtggcctcgtggcgcagggcgcgttgagtgcgttcgaggggttgcggccacgtagcgtggtggtgatgctcgacggccagattcaccgcagttgtgtgcgattggtggaaaccttgcattccccgatgcgccagccgctggttattacctccacgctgccacattacatcggtgcgctcgacgtgctgattgtcatcaccgacaacggtgcagatgaaaaagcgctcaaggcactcatcacggcgtcgcagcggggcgtggccacgctgctcattggccctagttcgggcccgcttatcgacgaatccccccaggacaccttcgtccttcccaccttgcccacggccgcaggcttgtcgcctgcccgcatcgtggcgtcgataagcactcttttagatcttttagaagcagaccccagcattatttccgaccgcttggaacacctcgccgactgcattgatgaggaagtggaatcgctatcgccggaacgtgacgaactagtcaatcccggccgaaaactgcgcgcatacgtagatcacgcacggatcgtgcataccggccgaactgatgtgggactcgcgattgccaacgttatcgccccaatctggacccgacgaggcctggtatcagccgtgctggattttcccgagctcatggaatcattgccggaactccgcggacccgagccaattaccgacgatatattccatgacccattcatagatgacgaacccggggtggtaccgtttagggctgttgtctgggccgaagaggaacccggaatccccgatgccatggcgcaaagctgcgacggacctagcaaaggggcgctgacacaagcactgcgtttgctggtgcgcggacagtcagccacgacctattccattgaagaaaaggacttgtaaatggagctattggaaggctcactgcgcacctacccatggggttcaagaacactgatcgctgatctcaaaggcgaagaatcaccatcgtctcgcccagaggccgaagtctggttcggtgcccacccaggatcaccatcaaccatcggtggaaacgcactcaacgaagtcatcgcagcgaaccccgaagaagcattgggcacgcgtgttgccgaagcgtttgaaaatgagcttccattcctcctcaaaatcctcgcagcgggagcacccctatcactgcaggcccacccatcgctggaacaggcccgtgaaggattcgcccgcgaaaactcagcaggaattgacctcggcgcaccgaaccgcaactaccgcgacccaaaccacaagccagagctgatcgttgctctcacggaattcatcgcgatggcaggcttccgcccactgcggaacaccctcaccattttcgacgccctcgcctgcgaacccctcgaccgctaccgcagcatgctcaccgtcgacaacgaggaagaatccctccgcgcactgtttaccacctggatcaccatccccatcggtaaacgacacgaactcatcgatgccctcatcagcaacgcccacacctaccttgaggcaagcgatcgtgacgaggacatcgcattcgtgctctcacacatcatcgagctcaacgaacagtaccccggcgatgtcggcgttctgggtgctctgctgttgaacttctacaaacttgccccaggcgaagccctctacctcgacgccgcaaaccttcacgcatacatcagcggcctcggcgtagagatcatggcgaactccgacaacgtgctccgcggtggactgacatccaaatacgtcgacgtcccggagcttgtgcgcgtgttggatttcaactctttggaaaacgctcgcgtggacgttgaagaagacggtgcaacgacccactacccagttccaatcaacgaattccaactcgatcgcgttgcagttcagggcgaagcagaagccaaccacgatggtcccatgattgttctgtgcacctccggaactgtttccttggaagcaggggagaagaccctcgaagtagcagcaggtcacgccgcatgggttccagcaaacgacccaaccattgcgatgcgttctgaggacgcagaagtattcctcgctagggtttagatctttttagattaaaatcatgcgccccgccagaacttggcggggcgtaaatctattttctgctcggattggctgacggggcgtgtctgctgccgtcaaaatctggattcggttggggagcctctgcacaaccgtcctatatggccaaaactaaaaagctcgaggcttttggtcacctagtttggtctggctcaaaacttgcatctgtacccaaatattagtgcctctcagaatcgcctgtaagagcttagaaaccttgtggtggcacttacacgcattgccacttttcgacctcttgaacgcccttctaaatgcacgtgaaattcaggtcgaagtggtttagctcgtggcagttggttccacagagttagctacagaattggatgttgtgtcagctggtgcgcttggtgttgcgtttggcgtcgcatcagtagttgaaccggctggctgatccggattgagaggagcagtaggttcctctacgaaatcggtaggtggcgtatcagactcatctggttggggagtgcttgttgaatcatcgctcgttggcggggtggacggagctaccggatcggttgtctcaatcggatcggttgtctcaatcggatcggtgggttccgtaggttcagaaggtccagttgggtctaccggatttgtaggttcggttggcctgtctgggctcgacggttgtgtagcagcagttgactcatcaccaggttcactaggctcgtttgacctggaggtgatttgagtcgggcttgccgatcctgctgaggagggagaactcacccgagaggtggtagttggagaactgccagaaggggttaaaccggagcttcggccattgtctggacgcacaaaagcattcggtggaagatatggatcttcggtgttgatgggcgccaaagtttggttttctaggtcaggttccgcctctttggtctctgtattacctggggaatcgtacctagcctgggtttgggtggtagacgtagtagtagacgtggcaatatcagaggtgggtcggcttgggctggacatctgccagaccataaaacccagggcggtggcggctaaacagccggcgacgatgaagacgagggctcgtcgagtttctgttttcatcgtggttcacctccgaagtgcagtagttgtctgaaaactggaaaataacaagtcaataacaaacgctatcatgtcttggctttcttgaataggtcgccaagtaaatatgcaggtaattagcgattttaaagttcgttgatgtgctgtctgaatcgtgtgggcgttagatgaattgttataaaccggatgtttaacggaatttaatacgtgtcttattacgcggactagaaaggttttagggacatgggtgcatgggacgatgcaatcttgactgaggaagtcaacgttgattttctcgacgagatctcagaattagatactcaagacattcttgaggcgttggaagacgcatgtttgctggtggttaaccaggacaacgccactgaagacgaacacctcaacggtcaggcggctgcgacgatcgcggccatcatgtttggcgctccatattctgcgggccaggtgctggagaattacccatttatccgcgaactcgtcggtgagggctctgaagctcttcgcggtgctgcagcgcaggttttggaagaggcagatgtggaatatgacctcgaagcttatttagaggccctcaactagccctccactaaacagcttcaatcaattcggtgtccactccaacatgtagagtggtgcgcgttaaaaaagttttcctaattttcattttcttaaaaggagctcgccaggacatggcacaggttatggacttcaaggttgccgatctttcactagcagaggcaggacgtcaccagattcgtcttgcagagtatgagatgccaggtctcatgcagttgcgcaaggaattcgcagacgagcagcctttgaagggcgcccgaattgctggttctatccacatgacggtccagaccgccgtgcttattgagaccctcactgctttgggcgctgaggttcgttgggcttcctgcaacattttctccacccaggatgaggctgcagcggctatcgttgtcggctccggcaccgtcgaagagccagctggtgttccagtattcgcgtggaagggtgagtcactggaggagtactggtggtgcatcaaccagatcttcagctggggcgatgagctgccaaacatgatcctcgacgacggcggtgacgccaccatggctgttattcgcggtcgcgaatacgagcaggctggtctggttccaccagcagaggccaacgattccgatgagtacatcgcattcttgggcatgctgcgtgaggttcttgctgcagagcctggcaagtggggcaagatcgctgaggccgttaagggtgtcaccgaggaaaccaccaccggtgtgcaccgcctgtaccacttcgctgaagaaggcgtgctgcctttcccagcgatgaacgtcaacgacgctgtcaccaagtccaagtttgataacaagtacggcacccgccactccctgatcgacggcatcaaccgcgccactgacatgctcatgggcggcaagaacgtgcttgtctgcggttacggcgatgtcggcaagggctgcgctgaggctttcgacggccagggcgctcgcgtcaaggtcaccgaagctgacccaatcaacgctcttcaggctctgatggatggctactctgtggtcaccgttgatgaggccatcgaggacgccgacatcgtgatcaccgcgaccggcaacaaggacatcatttccttcgagcagatgctcaagatgaaggatcacgctctgctgggcaacatcggtcactttgataatgagatcgatatgcattccctgttgcaccgcgacgacgtcacccgcaccacgatcaagccacaggtcgacgagttcaccttctccaccggtcgctccatcatcgtcctgtccgaaggtcgcctgttgaaccttggcaacgccaccggacacccatcatttgtcatgtccaactctttcgccgatcagaccattgcgcagatcgaactgttccaaaacgaaggacagtacgagaacgaggtctaccgtctgcctaaggttctcgacgaaaaggtggcacgcatccacgttgaggctctcggcggtcagctcaccgaactgaccaaggagcaggctgagtacatcggcgttgacgttgcaggcccattcaagccggagcactaccgctactaatgattgtcagcattgagggaatcgacggcgccggcaaaaacaccctggtttcggcattaacgcaggttattgatgcaaaagtccttgcattcccacgttatgaaacctcgattcacgcccaattggccgcggaagcactccacggccgcatgggcgacctcaccgacagcgcctacgccatggccacgcttttcgccctcgaccgccacttcgcgattgatgacttaaatgcgcccggcgtggtgctgctcgaccgatacgtcgcctccaacgcggcttataccgccgccagattgcttgacgacgacgccccccgctgggttgccgacctggaattcgggcggcttgggctcccacgtccgacgcttcaagtgttgttggatacccccgcggaggtagcgcaagatagggctagacgtcgagaagcgcttgactccgcgcgtgcgcgggaccgctatgaatcggattcggcgctgcagcaacgcaccgccgagcactatcgccgcctcgcggcggacaactgggaatcaccgtggatcgtggttgcccctgatgaagaccccggccacgttgcgcagagaatcgtggaattcctgggtactataaactaatcccaattagcaggaaggattctcatgtcacagaaaattctcgtggttgatgatgatcccgccatctccgagatgctcaccatcgtgctcagcgcagaaggctttgacaccgtagctgtcaccgacggcgcactcgccgtggaaaccgcctcccgggaacaaccggatctgattttgctcgacttgatgcttccaggcatgaacggcatcgacatttgtcgcctcatccgccaagaatcctccgtacccatcatcatgctcaccgccaaaaccgacaccgttgatgtggtgctcggtttggaatccggtgcagacgattacgtgaacaagcctttcaaagcgaaagaacttgtcgcccgcatccgtgcccgcctccgcgcaaccgtggacgagcccagcgaaatcatcgaagtcggcgatctgtccatcgacgtcccagcacacaccgtcaaacgaaacggcgctgagatttccttgaccccactcgaattcgacctcctgctggaactcgcccgcaaaccacagcaagtattcacccgtgaagaattgctgggcaaagtgtggggctaccgccacgcatccgacactcgactggtcaacgttcacgttcagcgtctgcgcgccaagattgaaaaagatccagaaaatccgcagatcgtcctcaccgtccgcggtgttggctacaaaactggccacaacgattaagtttttcatttaaaaaaggggcagtttctcattcttgcctggctcacgcgacttcgacatcgcattgtagataaatggcgaacctcactgcaggttcgcgtgctcggctccatcttcaccgcatcagctgtcgtgatgatccttttggggctgggcatgctgactgtattcacccaacggttggtggatcagaaaatcgatattgcgagctccgaaatcgaccgcgcccgcgtcatcgtcgaagagcaaatcaccgcatccggcgcctcaacatcggtgcaggcgcgagtgaactctgcccgcgctgcgctctccagcttgggtaccagcggcggtacagaaaccaacgccgcctacgatccagtcgtgttggtgaacaacgatgacctggtggtctctcccgagggttaccaaatcccagaacgtctgcgatacttcgtctctgagaaccaagtctcgtatcagttctccagcatcgaccaaggcgacggatcgtcctaccaagcgctcatcatcggaacgcccacggaaagcgacatcccgaacctccaggtgtatctggtgttctccatggaaagcgacgaatcctctcttgctctcatgcgaggactcctctcagctgcactgctgatcgtggtggtgctgctggtcggtatcgcatggctagccacccaacaggtcaccgcgccggtgcgttcggcgagccggattgcggagcgtttcgctcaaggcaaactgcgtgaacgcatggtggtggaaggcgaagacgagatggcccgcctggcggtgtccttcaacgcgatggccgaatcgctgtccgcgcagatcaccaaattggaggaatacggcaatctgcaacgacaattcacatcggatgtctcacacgaattgcgcacaccgctgacaacggtgcgcatggctgctgatctaattgccgatagtgaagatgaactttcacccggtgcgcgccgcgccagccaactgatgaacagggagttggaccgattcgagtcgctgctgagcgatctgttggaaatttcccgacacgacgccggcgttgccgaactgtccaccgcgcttcacgatgtccgcatcccagtgcgatcggcattggaacaagtacaacacttggccaccgagctcgatgtggaattgcttgttaatttgcccgaagaagcgatcaacattcaaggcgattccaggcgcatcgaaagaatcattcgcaaccttctagccaatgcgatcgaccactccaagggcttgcctgttgagttgaaagttgccgacaacgtggacgcagtagcgatcgttgttattgatcacggcgtcggcctgaaacctggacaagacgaattggtgttcaacagattctggcgagccgacccttcgcgcgtccgccattctggtggcaccggcctgggtcttgcgatttctcgcgaagatgcgatgcttcatggaggaaaccttgatgcggcgggaacgatcggtgttggttccattttccgtttggtcttgcctaaagaaccgcatggaaattatcgtgaagcaccgatcccgttgatcgctccagagacaccgtgggaaggggagcagcagtgagtaaaatttcgacgaaactgaaggccctcaccgcggtgctgtctgtgaccactctggtggctgggtgttccacgcttccgcagaacacggatccgcaagtgctgcgctcattttccgggtcccaaagcacacaagagatagcagggccgaccccgaatcaagatccggatttgttgatccgcggcttcttcagcgcaggtgcgtatccgactcagcagtatgaagcggcgaaggcgtatctgacggaagggacgcgcagcacgtggaatccggctgcgtcgactcgtattttggatcgcattgatctgaacactctgccaggttcgacgaatgcggaacgaacgattgcgatccgtggaacgcaggtcggaacgttgctcagcggtggcgtgtatcagccggagaatgcggagtttgaagctgagatcacgatgcgtcgggaagatggggagtggcgtatcgatgctttgccggacgggattttattagagagaaacgatctgcggaaccattacactccgcacgatgtgtatttctttgatccttctggccaggtgttggtgggggatcggcgttggttgttcaatgagtcgcagtcgatgtccacggtgctgatggcccttctggttaatggtccttcgccggcaatttctcctggtgtggtcaatcagctgtccacggatgcgtcgttcgtggggttcaatgatggggagtatcagttcactggtttgggaaatttggatgatgatgcgcgtttgcgtttcgccgcccaggccgtgtggacgttggcgcatgctgatgtcgcaggcccctacactttggtcgctgacggcgcgccgttgctgtcggagttcccaacgctcaccaccgatgacctcgccgaatacaacccagaggcttacaccaacacggtgtccacgttgtttgcgttgcaggatggatcgttgtcgagggtcagttccggcaatgtgagtccactacagggcatttggagcggtggagatatcgattctgcagcgatttcctcctccgccaatgtggtggcagcggtacgccacgaaaacaacgaggcagtgcttactgttggctccatggaaggcgtgacttcagatgcgttgaggagtgaaacgatcactcgtcccacctttgaatacgcgtcgagtgggttgtgggctgtggtggatggggagacgcctgtccgagtcgcacgatcggcaacaaccggtgagctcgtccagacggaggcggagattgtgctgccaagggatgtgacgggtccgatctctgaattccaactgtcacgaactggggtccgggccgccatgatcattgaaggcaaggtgtacgtgggcgtcgtaacgcgtcctggtccgggcgagcggcgcgtgacaaatatcacggaggtggcgccgagcttgggcgaggcggcgctgtcgatcaactggcgcccagacggcattttgcttgtgggcacgtcaattccagagacgccgctgtggcgcgtcgagcaggacggatcggcgatttcgtcgatgccgagcgggaatctcagcgcgccggtggtggcggtggcaagttccgcgacgacggtctacgtcactgattcgcatgcgatgcttcagctgccgactgccgataatgatatttggcgcgaggtgcccggtttgctgggcacgcgtgcggcgccggtggttgcgtactgatggagctgttcttcccgcgcgcatgtggtggttgtggggcgccgggggcgtcgttatgcagtgactgccagcgtgtgtggaggaagccgccaacattggcgcggcttgatttagatttaccggtgtggacgttgtcgccgtatgacggcccgcatcgcaacgtgctcattgcgctgaaggagcacggccgtgcagaccttgtggcgtttgtgggcgcggtggtgggggcgtcgataagctatctggcggctcagggggaaattgagcacgacatcacgctggttccggcgcccacccgcgccacctcgcgacgccggcggggcggcgatccggttgagcgggtgtgcaatgcatcacgcttatcgacgtttccctgccttcaaatctcatcccgcacaccagactccgtcggtcaaactgcgcaacagcgaagactcaatatgcgagtggagttagtccgacaacctcggggttctgtcttgatcatcgacgatgtggtaacaacgggggcaactatttccgcatctgcaaacgttcttcgcgcagcgggtgtgcaggtcagaggagctttaacttattgccaagcgtgatcttggatataaaaggggcccctattggcaatgtggttatgaccagaagtagtataagaagtgaagttgatcgcgtcatcgtagtacgagtaattccactcacacatcaatgcggtgaccacaattgggaggagaagtagcacgtgactacacctgctgagaacaacacccttagccccgagaccaaagtaagcatcactggtcgaaacgttgaggttcctgatcactttgcagaacgagtaaataccaaactcgcaaagattgagcgcctcgacccaacgctgaccttcttccacgttgagctacagcacgagccaaacccacgtcgtgctgacgaaagtgatcgcattcagatcaccgccaccggcaagggacacatcgcccgagcagaagcaaaggaagacagcttctacgcggcactggaaactgcactagccaagatggagcgctccctgcgcaaagtgaaggcacgtcgcagcatttcccgctccggtcaccgcgcaccactaggcactggtgaggtcggtgcacagttggtagccgagtcccaagaggcacgcggtgccgatgaactgggcaaatacgatgttgatccttatgcagataaggtcgatgacgtcatgccaggccaggttgttcgtaccaaggaacacccagcaaccccaatgagtgtggatgacgcactatccgagatggaattggttggacacgatttctacctcttcgtcaacgaagagaccaaccagccatcggtggtgtaccgccgacacgcattcgactatggattaatttccctgtccgatgcatagcaattagttgctaagtacccgctaccgtaacggtagcgggtactgtgttttaggaaccgtgcgtagttttaggaacagtgcgtacaatataggttcgttatcatttccgtatcgctatttataaggacgactgctcgtgtttggattgtccaaggtgctccgcgtcggcgaaggccgtgccgtgaagcgacttcacaagatcgctgaccaggttatcgcgcttgaagataagttcgccaacctaaccgatgaggagctcaaggcaaaaacagccgagttcaaagaacgcatcgctggcggtgaaggactcgacgaaatcttcctcgaagcgttcgcaacagcccgtgaagcagcttggcgtgtgctcggccagaagcactaccatgtacaaatcatgggtggcgcagcgctgcactttggcaacgtcgccgaaatgcgcaccggcgaaggcaaaaccctcacctgcgtgcttccagcatatttgaacgcacttgaaggaaaaggcgtccacgttgtcaccgtcaatgattacctagcaaaacgtgacgcagaaatgatgggccgtgtgcaccgctacttaggcctcgaagtgggagtaatcctctctgacatgcgcccagacgagcgccgcgaagcctacgctgccgacattacctacggcaccaacaacgaactcggcttcgactacctgcgcgacaacatggcacgctccctaagcgacctcgtgcagcgtggacacaactacgccattgtcgacgaagtagactccatcctcatcgacgaagcccgcaccccactgattatctccggaccagtagacggcacatcgcagttctacaacgtcttcgcacagatcgtcccacgcatgaccaaggacgttcactacgaagtcgacgaacgtaaaaagaccgtcggtgtgaaagaagaaggcgtcgaatacgtcgaagaccaactcggcatcgacaacctctacgcacctgagcactcacagctggtcagctacctgaacaacgccatcaaggcacaggaactgttcacccgcgacaaggactacatcgtccgcaacggcgaagttatgatcgtcgacggcttcaccggccgtgtccttgccggccgccgatacaacgaaggcatgcaccaggcgatcgaagccaaagagcgcgtagagatcaaaaacgagaaccagaccctggcgaccgttaccctccagaactacttccgcctctacaccaaactcgccggcatgaccggtaccgcagagaccgaagcagcagagctcaaccagatctacaagctcgacgtcatcgcgatcccaaccaaccgaccaaaccagcgcgaagacttgaccgacttggtgtacaaaacccaagaggctaagttcgcagcagtcgtcgacgacatcgcagaacgcaccgaaaagggccaaccagtcctcgtcggtaccgtctccgtcgagcgctccgaatacctctcccagctgttgaccaaacgaggcatcaagcacaacgtcctcaatgcgaagcaccacgagcaggaagcacagatcgttgctcaggcaggtcttccaggcgccgtcaccgttgccaccaacatggcgggccgtggaaccgacatcgtgctcggcggaaacccagaaatcctcctcgacatcaaactccgcgaacgtggacttgatcctttcgaagacgaagaaagctaccaggaagcctgggacgctgaacttccagcaatgaagcagcgatgcgaagaacgtggcgacaaagtccgcgaagccggaggactctacgtccttggcaccgaacgccacgaatcccgacgcatcgacaaccagctgcgcggtcgttctgcacgtcagggcgacccaggatccacccgcttctatctctctatgcgcgacgacctgatggttcgcttcgtcggcccaaccatggaaaacatgatgaacaggctcaacgtcccagacgatgtgcccatcgaatccaaaaccgtcaccaactccatcaagggcgcccaagctcaggtggagaaccagaacttcgaaatgcgtaagaacgttctgaagtacgacgaagtcatgaacgaacagcgcaaggttatctacagcgagcgacgcgaaatcctcgaatccgcagacatctcccgctacatccaaaacatgatcgaagaaacagtcagcgcatacgtcgacggcgccaccgccaacggctacgtcgaagactgggacctcgacaaactctggaacgccctcgaagccctctacgacccatcgatcaactggaccgacctcgtcgaaggcagcgaatacggcaaaccaggggagctgtccgccgaagatctacgcaccgcactcgtcaacgacgcccacgccgaatacgcaaaactcgaagaagccgtatccgcaatcggcggcgaagcacagatccgcaacatcgaacgaatggtgctcatgccagtcatcgacaccaaatggcgcgaacacctctacgaaatggactacctgaaagaaggcatcggcctgcgcgcaatggcacagcgcgacccactggtcgaataccaaaaggaaggcggcgacatgttcaacggcatgaaagacggcatcaaggaagaaaccgtccgccagctcttcctcctccgcaagcagttcatcaagcaagacgcggaagtcgctgactaactcagaaccctgaaattcagcatccgccacatgccgcccgattcggccaatcgggcggcatatgccgttctccgaacacccatagaaatactcccgcacacttccgcagacttctctccgagttggacatggcaagataacagatccgccgactcggtaaaccccagcctgcggcgagcggaaacgtgggcgcggacgggggcgtcgaaaagcttcggggttaagtgagcgattggccgaaggccgaacgcggaatccaaagcgaccctcaccagcactgacacctcgcgcggcacttcggtgcgtgcgtggattgcctgaggcaacggatcgggcacaagatataacaaatgtgcgaaacctggaattggaacaagcacaacaaatctccttgagagaaaatctcaaggcaaaaaacaagccaccccaatctgtgcgacaatcaaaccacagactacgactattatgtcacgaagaaaccaaagaaagggaaataatgcgcggactaattgttgactacgctggagtactagacggaaccgatgaggaccagcgtcgctggcgcaacctgctcgccgcagcaaagaaaaatggcgtcggaaccgtgatcctcagcaacgatccaggtgggctcggcgcagcgccgatccgggaactcgaaacaaacggggtagtcgataaggtgctgctgtcgggagaacttggcgtcgaaaagccagaggaagcagctttccaggccgccgcagacgccatcgacctgcccatgcgtgactgcgtgcttgtcgacgactcgatcctcaacgtgcgcggcgccgtcgaagccggactcgtaggcgtctactaccagcaatttgaccgtgcagtcgtcgaaatcgtcggactgttcgggctagaaggagaattctaatcttgcgcgtctacatcccagcaacgttttccacactccgcggactcaatgaatcccgcgtcatcacagcacgctccggatacggtttcgcagtcaccccagcactccttgacttctacaccgacggtgacgaagaagaaatcgcacatgcagccttccaagacgccgcagaagcctccatccgactcctcgcaatcggcgacgaagaaacatttccctaccgcagagtcgtcgtctcagtagatgttgacgactccgtggtgacctaccagcctgaaaacggcgaatccgtagtcaaactcagcccagcgcacatcaacctcgacgacgtggcagcaatccacatcgacgttgaagcctccgaagcagacaccaaaaaagctatcgaagtcatcgacgaatccgacctcggcgaagaagacgccgaactcaccgtcggagacgcccaagacaacttcatggcctggtacgacccagaagagctccccttcctagtcgagctcctctagatcacatatcccacgcgtcgttgctcctcaacgcaacgagcaacgcacgcaccgcctcaacacgacgcgcactcgcaccctccaggcgatccaacgcacaaccaggatccgccggaggacccaaatgcgaacacccacgaggacaatcctccgccgctaaagccaaatcgtcgaacacaccaaccacagtgtccgcatcaacatgcgccaaaccaaacgaacgaatacccggcgtatcgataatccaaccattatcaatggcaagagcgaccgactgcgtcgacgtatgccgacccttgccaacccccgacacgacaccagtctcacgatcggcatccggcaccaaacgattcaccaacgtcgacttacccacaccagaatgcccaataagcgccgtaatatggccctccacgacctccaaaacaggatcaagaggatcatcaacaccacaaacaacaaccggcacttccaaagcctcaaactccgcagcgaactccgcaggatccgccaaatcagacttcgtcaaacacaacaccggctgcaaattaccaacaaacgcagcaattagagcacgctccacaaaacccgcccgaggcggcggatcggcgacagcagaaacaatcaacaactgatccgcattagccaccacaatccgctcaaacgggtccgtgtcatcagccgtacgacgcaacacactcgtgcgctcctcaaggcggacaattcgagccaacgagcccggacggccagacgtatcgccgacaactccgacacgatcacccacttcgatagccgtacgccccaactcacgggcacgcatcgtcacaatggcatcttgacgaccatcgagaacaacaccccaacgaccacgatccttcgtcacaaccatgcccactagagcattctcatgcgatggccgatccttcgtacgagggcgggtacctttacctgggcgaacacgaacatcggattcgtcatagctgcgtctagccaaccatctcctcccaaacattttcaaaaccagggaaagttttggaagtggtcttaatgtcttcaacctgaacgccatcaaccgcgaggccaatgatcgcaccagcagtagccatacggtgatcagcatatgaatgccacacaccaccgtgcagcgacgcaggctcaatcaacagaccatccttaagctcagtgcactttccaccaagtttgttgatctccgcagtcaacgcagccaaacgatccgtctcatggccacgaagatgagcaataccggtcaaacgagactctgtcgacgccaacgcagccaacgccgccacggtaggggtcaactcaccgatatcggacatatcgatctcaatgcccttgagagcaaccggaccagtcaccgacagatcgtaaccttcaccctgagcaaccagctcaacttcgcagcccatgcgctcaagaatcgaacgaatagcatcgccaggctgagtagttttgattggccagtggttaatcttgatggttccaccagtgaccgcagcggcagctaggaacggagtcgcattagaaagatccggctcaatgcgccaggtccgacccaagatctcaccaggatgaacaacccactgattttctgactcttcgatctcaatgcctgcggaacgaagcatatcgacggtcatctcaatatgcggcatgctcggcagacgaccaccgacgtgcttaacggtgacgccatttttaaaacgaggcgctgaaagcaaaagaccagaaacaaactgagatgagccggaagcatcaatctcaaccacgccaccctcagggacctcaccagcattaacagtgaaaggcagattgttgttgtctacctccacaccaagcgaacgcagcgcatccaaaatgctggtcatcggacgaacacgagcttgaggatcgccatcaaaatgaacaggaccatcagcgaaagcagcaacaggaggcaaaaagcgcatgaccgtaccagcaagaccacactcaacggagccagcagacaactgtccgggctcaacgcggtagcgatcgactgcctcttcagtaatggtgattccgaggctgcgtagaccatcagtcatgagatcggtatcacgactacgaaggacatcaatgatggtggatggagttgatgcgagcgcagccaagatgagggcgcggttggtgatcgacttggaaccagggatagccaggtccgagactatggggccgcgagcgcgcggagcatcccaaatgggcaaagagatagacgaatcagacacaaagaccataatagatgttatgtgtggaagatttgttttgttcaccaccggtgattcgcttattgatgcaaccgagatagcacttgaccgatcagtcgtggctccgcaaggaactccgggaccgcgatacaaccttgctccgactcagataattccgatcgttcgccccggggaagagatgcttttggaaccggcgcgttggggattgtttccgcattggaagaaggatgattcaggtcctccgctttttaatgcacgtggcgagacggtggcggagaagccgtcgtttcgtgatgcatttaaacagcagcgttgtttaattccgatggatggttattacgaatggcacgataagaagcctcattttgtttctttaggtgatgagctgatgtgggctgcgggtttgtggtcgactggtttagatcagatgtcggcgacgatggtgacgaccgaatctgtggagccgattgcatggttgcataatcgtttgccacggtttttggagcatgacgagttggagcaatggctgtttggtacagctgaggaagctaaagagatgttgcatccggtttctcaagagtgggtgaagcgcttgagtgtccgagaggtgtcgtctgatgtggggaacgtgcgtaacgatcacgctggcttgctggattaggcggcgattcgacgctccatgtatttgccgaactttgtcccccaggttttattcgatttagataaaggcccgtcggggatggagaacaccggtattccatccactaggaataggacggtgccgtccggtagtggatagcactggagcctcccttcagtcttctggatgtggtggaagacacacaggggatgaatattccacggtgttgtcggccctccttcaccccaggggatgatgtggtccagttggcagttttcgaccgctacactgcagccagggacgctacaggtggtgcgtagacctttgatgtagacgcgcatttctcgggttggagcgtaggcggtggtgtaagagaagtgggcggcgtccatatcccgactggacgtggttcgggttttccagaactcagactgttcctttgacagccaggttcctccttctaagtattcagggctgtctttggtgccgtaggtgttgagtacgacttttgtcggcaggccacgaatgatgtggagtagggaagtgcctggtgtgcagtccttatctttggacatttgttccagggcagctttgatttctgttacttcgctggcggtggcatcgacggtgatactgatcccgcctttgttgtttctgcggtagcggatggagccatcattggtggctgaggaggccttgtcgtcggggcagtgttgtgcgataaatttccgcatcattgcggaaattgagcttgcctggggcaagcactgagcctccgctcgaggcgtcaggtaatcgacgaggtaggcgtcgaaaagctctctcttctcgcttggcactttttcgccagctttagtgatcgcgttgatgcgcgccatgtcgagatgaccaagcttttcgacgagtttgtggaagttgggtaagtacggcaggaagcagatgctaaataaacaagcggcgatcagtttgcgggataagcctgtgcgcacgcatattttgttgatggctgtggctaaatcatcgtcatctttggggcgtaatcgatgccaaaatgcgaggtcacggcgattagtctcaacaatttcggtgcttaaaggatcctgcggattattgacggtgaagtagaacattgtttccccctagatttgaagtggtacatatgttctaactgatgtggtggacacgcgggggtagagtaaagtctaagcaacagctcacgtggctttacagctacccccgaaaggtctgttttttatcggaagtagaatagtcaacacgcattttcgaaaggggccacatggctgaaaaccgaaccggcacagtcgatggagacgcgttggctgcccgctttgaagaggaggcactgccactccttgaccagctctatggcggtgctctgcgcatgactagaaatcccgcagatgcggaagatctcgtgcaagacacctatatcaaggcgtaccaggcgttcgcgagcttcaaaccaggcaccaacctgaaggcttggctctatcggatcatgacgaatacctacatcaacatgtaccgaaagaaacagaggcagccatcgcaaacctctgccgatgagatcactgactaccagctcgttgaatctcaatcgcatacctcaacagggctggaatccgccgaggttgaggctctgaaaaatctgccagacggaaaaattggcgatgcaatgaatcaactcagcccggaataccggatggtggtttattatgccgatgtagaagatctcgcatacaaagaaatcgccgagatcatggacgttccactcggaactgtgatgtcccgactccatcgtggaagaaaacagctccgaggaatgttaaaggaagtagcgaaggaacaaggcattggtcttgaacatcccgacatgaagaaaaattcggaggcataacgatgacgaatctcaaccgcagcgactcgcaaggtgattgtggctgccctgaattcttcgatgaaatgtatcagctactcgacgatcaactcagcgagtccgcctgcgagcgtctgcggattcacgcggcaggctgcccggcatgccagcaactgctagaggccgaatcggagtttcgtagtctgttgcgcaagtgctgctgcgaatcggcacctgtggagctccgtcagcgaatttcttaccgaattcgtgtcgagcatcatctggaatagaaaaaaccgcctggaagaaaatgtcttccaggcggttactctttcttaagagttagggcgacgtccgtggttcgcgcccttcttgcgacgatccttacgcttacgtcctcgcttgctcatgagtcctccttttagttcaaatgttgatcaactgtagatactttagcgggtgctcatcagcggaacaaagatgaggttacgcagcgggaaaaatgtagttgtgaaagttgtttaaactgcgatgcgtgcgcgaccgcggccacggttcttgcggcgcttgagagcgcgacgctcgtcttcgctcatgccaccccaaacgccagcatcctgaccggtttccagcgcccatgcaaggcactgggaggtaactgggcagcggttgcagaccatctttgcggatgcgatctgtgcgagtgctgggccggagttgccgactgggaagaacagttcgggatcctcttcacggcagattgcttcgtggcgccaatccatttcgataactccttttcgtaaaagcctgttgttgtcactggtccgggcgcgcaggaaggagaccatctagtggcctgaagagtggatttcacaacccgcgatcgataaatacggacgctctttgcgtcctgccgtttacctggggttcatcttgcgctgcaccggtgttaagaatcagttttttctgagttctttttggtacttgaaaatagtctcatgtacacccgctgttggctagacctagaccccattttgtgaggtaattcacatattcaggccgagttttaatcgaattcaaggcatatattgtggggtggaacacattgccctgctgtttgaggcgtgttaaaaggcggactacctgtagtttcttgaaaactagagaaagaacactctcgcccgatgtgtcaaatccccttaaagctttcaccggaaagtattgtcacctggtgcaatataaaagttaaccaaccagtcatccaatatgtcgcctaagtagtcttcccaaagttaacagctagaatcatggccgtgacttctccgaacatgcctgcatcaattcgctggggcggcatcgtcgccctcattcaatccaccatcggattcggttacgcctttttccttatttacagggaagctacgggcgagacggatccaagcatcgtctacgaaaccgataacgccaacacgtgggttggctacggtaccgctgcattcttcatcattgtgttcggaacggttgttgcaggcgcaatcaacatgatgaaggggcatcgctggggacgcggagctgtcgtcatgctgaatattattttgttgccggctgcgtattacatgtttatcgaaggccgattctcctgggcgatcgtcacaggaatctcagctctcttcgttttgggcgcactgtttaataagcgcgccgtcctttgggctaacaacgagatctagcctagagcaacgatctcagagccacgcttttcgacgatcacctgccctacaacgccgagcgcaacttcaccgtcgtagcccgcacggtccaccggaatggtgcgctgcacctctccggtgtcccaattagctaccgtgatgccctcagcggtggggtagaggagacttccgttcaacgcaatgccggttcctaaagcatcattgaagctttgtcgtacattgagctgagtgggagagaacagtacgaggctgtctccgttgaaccaactcatatggtgtggaagatcagcggtcgcgctttgaaacggcggatccgggaactcaacctcatcgactgcttgttctccaactagttcaccatcatcgttgtaggagacgattcgaggcgaaggatcgtttgtatacaccgcagccactgattgaccgatggcaacgatcctgccatcggttatttctatgtcttgggtgatttcaggagttcgggaatcgtctggtgttgtgcccatgaacctcaagtaagaagatccgtcagggcaatcctcggtgatagccaatagatctttgcgtgtcatggcggacgtaatcgagcattccggatgtggttgttgcccagattcttgaggagcttccacatcgccgtattcgatggttcgcaccagatcggatcgccaaagctccaagcgttctgtcccgagaacaccgatccgatcgttcgaggagatcggtgctacgtggtcgctggagattgcgctgcgtgttgcttggtattggccgtcgttggcgttgatggcggtgacgtcgccacatccgattccggttttgtaggtggcgacggcggcgtcgaatcctacggagaggctgcagagttctttgtcgcgttcgtagctccacaggagggcgccgtcgggggtgtaggtcttgatggtgttgccgtcggcggtggagatgactccgccggtgatgaggggtttgtggtttgttgaggtgtcggtggctcgccaatgttcgctgagtgtttcggggatggcgtccagtgtggttgaggcgatgaatggttcgtcggcgggggtgagttcagatcctcgtattggtgcggttgcccagaccgtgccgacgccaatgactgctagtgctgtgatgacaccggttgcgatgaggtcttttttggtgcgtttgagtggttgaagctttgctgccataagttatttccgggtgcggcgtggtggtcgtggggctgttccgcctagaactttggttggtggtccgactcgttcggtgacaccttctgggatgtcgagtgtttcaagcagctctggtgaggtggagaaccattgtggtgggtttggttggccgagttcgagttcgttgtcgatgacagtccatttgagggtttcgtcgtagccgacaagagtgacggctgttccgttgtgccctgcgcgtcccgtgcgtccgatacgatggacgtaggtcataggatcgtcgggggtttggtagttgatgacgtgggtgacgtcatcaacatcgatgcctcgggcggctacgtctgtggctacaaggatgtcaatttttcctgtgcggaatgcgttgagtgatttctcgcgggctggttggcccatgtcgccgtgcactgatccgacggagaatcctctggaggctaggtcttcggcaacttgcgctgcggtgcgtttcgtgcgggcgaagatgatcgttttgccgcgatctttcgactgcagaattttcgcggtgatggcttccttgtccattttgtgtgcctgaaaaaccacttgtctggtggttttgtgtgttgctgaggcgtccgatgtctcggctcggatgtgcactggtttgttcaggaagctgcgtgcgagtgtgaggatcgcgccgggcatcgtggcagagaacagcatggtttgatgctggtgggtgagggcacggaggattttttcgatgtcgggcagaaagcccagatcgagcatttcgtcggcttcatcgaggactaagatcgctactttgtcgagcgatagcgcgcctcgtttgtgcaggtcgagtaatcgtccgggtgtgcctacgacaacgtcgacgccgactttgagtgcgtcgatctgttcttcgtagggggtgccgccgtagaaggtgaagatctttagcggcaggttggttgctgcgcgttggaggtcgtcgccgacttggactgcgagttctcgggtgggcacgatgacgagggctcggggggtaccgtcggtttctgcgacgtcggctgagtcgaagactctatcgaggagtgggacaccgaatccgtaggttttgcccatgccggtgcgggcttggccgatgaagtcgtggccgtcgagcgcgatgggaagtgtgtactcctggatcgcgaaagttcggttgatgccgagggcttcgagtgcgtcggtgatttccaccgcaacgccgagctctgtgaacgtaggtctggggctttcagaagacacaacttagatactatcgttgcacggttacaatagggtcattccaatacaacgattcttttaggagagctatggatatcaagatcggatttgccgatactgcccgtgaactggtcatttcttctgctttgcagcaggatgaggccgctgcgaaggtgtcggaggctttggctaatgattctggcgttttagatttgagcgatgaaaagggtcgccgttacattattcgtaatagccgaatcgcttatgttgaggtcggcacgagtgctcctcgtactgtcggcttcgctggcgcataggggcttttagacacgtgtcgtctaaggaaccttttttggtccgctttgcgcgggattatggttggcgtgcgtacgccatcccggtgttgacggtcattactgtttgggtgctgttcgacgtgttttctgccgatcagcccgctaatggtgcgagtggggaagcgtcgacaagcttatcgacgcccacctccaccctccgcgccggccccgaccccgcgcaggccgaaccgcaaagcgttccgctgacggaactgccgcctggcggcagctacaccgaaaccggtgctggcactttccgccaggtcggcgctgctcttcctcgcgtgggcgaggggcaggaacaaacttttacgtacgtcattgagattgaggatggcgtcaacacggccgcttatggtggcgacgatgcgttcgtcgcagccgtcgatgcgaccttgtccgaccccaaaggctggaccgccgaccccgcgtttgccttcgagcatatttctggcgacgaggacccggatctgcgcattcaactgacctcgctgagcactacgcatgagttgtgtgggaatgacatcgagatggaaacgagctgtttctactccgatggcggacgcgtcatgatcaacgaatcacgatggatccgtggagccgcaccttttaagggcgatctgggctcttaccgccagtacttaatcaatcacgaagtcgggcacggcctcggctacgccgcccatgatgcctgcaccgcccctggcgagctcgctccgattatgatgcagcaaactttgagcttgaataattctgaacttttccgcatcgacccagatgaggtttaccccgacgacgacgccacctgcgaattcaacccatggccgtatcctcgcggattttaggagataaatgtctaatcaattacccgatcacgtccgcgacgccttccaagtaggtgcgggacctgccgaacaactcggtcaagcttgggacttcggattccgcgtcggcaacactgtgttcgccaaagtgacggcgccggaagtgtcgggctggtcgtcgaaaacccgcgaaaccctgaaaccagaaggcgtgcgcgtcgtacgaccgatccgctccaccgacggccgatttgtggttgcggggtggcgcgcatcggtgttctctacgggaacgatcagcaagcgagtcgatgagacggtcgttgcgggtcttcgtttggcagatgcattagtggatacgcatgcaccggaacctgtggacaatgtgtttaaccgtgctgatgtgcaggcctgggaagagcagcccggtcgaatcggtgaattgttggagccgattaatcgcgtgaaccaggttggtcatgcggatatgttggcgacaacgctgtatgcgggaactcagccacctgcagtgacggatttggtgccagtgctgcgtccgcatggtttcactgcggcattggtgatcgttgatgggttgctgctgggtgcggttgatgagggaattctgcggaggttttcgcatttgccggaaattgagcagctggttttgagggcatttttgttccgtcgaaacttgcaggagttctctgagaacaacgatccgaatgttatttcgaacctaaacagggtggaatcgacactcgtgtcgtatgtttctgacaagatttgaggtatgtcggaatacaaaccacccattccatcggatccacaagttcggctgattaagccaacatccaagcttcgtcctcgttcgtgggagggcgaagtttcgcatttagttaaacaaggcaccggtttgtggcgggtgactggtgaggcgggctcgggggtgagctccgctgttgtcgatactgtccttgaacgcattcgccaagggtgggagccgtcatcgatgttggttgtcgccacgtcgaaagaggcggcgagtcgcttgaggcaagagatctcggaatccgtagcccagatggattatgtgtcggaggggccgttggtgcgatcggtgcactcggtggctttcgcgctgattcgtgatgcgtcggatgatgatgtgcggttgattacgggcgctgagcaagatgcggtgattcgggagttgctgcgtggtcatgctgatgatggtcgtggggggtggccgcaggagcagcgtgagggtttgcggatggtggggttcgctaggcagttgcgtgactttttgcttcgtgcggtggagcgtggtgtgggccctgatgagttggtggaattgggggagcgatttgagcgcgccaattgggttgctgcgggtgagttccttcgtgagtacaagcaggtgatgaagctgtcgggggcgcatagtttttctgcgtctgagttggtgactgaagcgctgcgtggtcctgagccgtcggtgaagtatcgcggtgtgtttattgatgatgcgcagcatttggatccgaagtcggcggaacttgtgtcgcggtttttccctgaggcggagttggctgtggtggcgggtgatccgcagcagtcggtgtttaggttccgtggtgcgaatccggattttctcaccaagttgagtgtggatcacgaggtggtgttgaaggggaggaggaaagcgtcgacaagcattgtcgtggcagagaccgagtcggcgcatgcggacctgcttgctgacacggtgcggcgcgcgcatctcattgatgggcgcagctggtcggagatcgctgttatcgtgcgctcggccggcatgattgcgccgatttggcgcaccctgctggccgccggcgtgcccgtgcacatcagcccgactgatgtggtgctcgccgaacaacgtatcgttgccgcaatgattctcgggctgcgcgcgctgacggaatcgctcaacgccatcgagttggaggatcttctcctaggaccgatcggtggcgccgatccggtgactctgcgtcgtttgctgcgcgggttgcggcaggcggagatgaagatgggtgggcagaggcgagcgatcgaggtgctcagaagcctgctcgcagagtcggatgcggagatgttgggctttttgaccgatcgtgagctgaatttgctcgagcgggtgcgatctgtgttggaagcgggtcgtgaagcgctcgcggaacacggcagtatcgaagaggtgttgtgggcgctgtggtcggcgaccgatctgtcgaactcgttgtccgcgatcagccttcgaggcggcgcatcggggtcccaggccgatcgcgatttggatgcgatgatggcgcttttcgacgccgccggcgactacgtggagcgctacccgtcagcgggcgtgcggagtttcattctgcatatttctgagcaggaacttccgaccggcatgcgtgagcgacgcggcgcgatcccggaggccgtcgaggtgctgacggcgcacgcgacgacgggtcgtgagtggaagcgcgtgatcgttgctgaggtgcaggagggcagttggccgtcgctcggtgaaactggcacgctgcttggtcaggaagagttcgtcgatttggtggatgagggtattgatcccgatatcatcatttcccgatccgccgaacgactggcggaggaacgccgactgttctacctcgccaccaccagatccaccgaatcgctcctggttaccgctgtgaattcccccgactccgacgaagtccgcgaaccctcccggtttttggaattgctgagtcaaccgatcgttgttctcgagggggaggaagcttcggcgatcgcggaaccggaggagattgggcatcggttgttgtcgattcctgcgatggttgctgagttgcgtcgtgtggtgaatgatccgcgggatccgcgtcggaagcaggctgcgaggcagttgtcgaggcttgcggaggcggggattccgggtgcgaatcctgccgagtggacgaatctgcgcactccgtcgactgatgaggagttgatcaagggggcggtgtcgttgtcgccgtcgcggattgagcagttgttgaattgtccgctgcgcgctgtgttggatcgtttggacagtgaggaggaaacgccgatcgcgatgctcaagggcaccttggtgcacgcgtttgcggaggcggtcgccggtggcgtcgatgcggcgctcgccgaagagaaggtgaccagcgcctacatgcagctggcgaacgtgccgagctggtcgcgcgaaagcaccgaaattgcttttcgacgcatcctctcacgtaccgatacctggctgaagacttctcgcgccgattttacggaagtgggaacggagatggacgtatcggtgaccatcgatgactccgtatcgatccgtggtcgcatggaccgtttggagcgaaacaaatccggcgagttggtggttgttgatttcaaaacgggcaaaactcaaatcgctgcaaaagacatgggcgatcacccacagttgtttgcgtatcaattggcgttgtcgaaaggcgtgctgcatggtgacaaaatcagtgaccccaatcccggcgaaacccccgatcctgtaggcggcggattgcttgtctacccagcaaccgacaccaaggcagtcggccagcgaatgcaggatccgaaaactcaagaagatctcgacgatttcgcagcgatgctccccggcttggcagaacacctccgcggccccaatctgctcgcccgagtaaatcccacatgctcgacgtgtcccgttcgaagcctgtgcccagttcaacccgaaggacgtgtcatccatgcgtaggatttctcctcgactgctctcccaatatttgggacaagagcatgcgccaactgatcagcaatctgcgatcattggatccgaacccggcccactgttggtagtggctggtgccggcgcaggaaaaacggagacgatggctgcacgagtggtgtggttggtagcgaacggattcgtcgccccagatcaagtgctgggtctgacatttaccaggaaggcggcgcaacagctgtcgcagcgcatccgaaagcgtttggagactcttgctggtgtgcctcgcctgaaagacattgatcccaccggccagttggagaaaaaccttcaggcgatcaccccaacggtatccacctatgactcctatgcgggcacgttgattagagaatacggattgctgcttccagtagaaccttccgcaaggttgatcacacaaacggagctttatcacatcgctcgcaacgtggtgaacaactacgacggtgagctcaccgccacccaaacgccggccactgtcacggaatacctcctcaagctggtatccgaaatggacaaccacatggttaccgcagaggatatccgtgaggagtccgatccgttcattaagcttttcgacgaactccccaagggcaagggtcagcgcgacaacctcaacgccgaaatgacgaagtggcgggatacacaggtcgctcgcctccagtacttgcccctcgtgaaggctttgaaagaggaactgcacaatcaggctgtggtgacgtttggtgagcagatgtctaaggcagctcatctcgcatcgacgcatcctcaggtgggctattcgcagaggcgacggttccgcgttgtcatgcttgatgagtatcaggacaccagccactcgcagcgtgtgttgttgagcagtcttttcggtggcaccgatcctggtctcactgttaatgctgtgggcgatccaatgcaggcgatttatggttggcgaggtgcgacagcggcgaacttggagaatttcgttgacgatttccccgtcatccatctcgatggaaaaacgagagcaccgaaaaacgagttgaccacaagttggcgaaacccaccagaagtcctcacccttgccaacgcagtttcgcgggaggtgcttgggtcgcccgatgcgccgactcggacggtgcagccgctgcagcctcgggaaggcgcaccgaccggtgaagtgtcgctcggatggtttggtacggcggcgcaggaacgtgagtttgtggctgatgagatggtgaagcattggaatgcgcgggaggagaagggcacatttactgctgcggtgttggtgcgtaagaagcgtcattcggcaccgatggcggaggagctgaccaagcgtggcatccccgtggagatcgtcggactgtctggtttgttggatatccctgagattgccgatctaatttctctagcaactatgctcgtgcgtcctcacgataatcgggctgcgttgcgtattttggcgggcccgcatgtgggtttgggtgtggcggatttgcagcggttgcagggtcgtgcgcgcaatattgcgggtcgtgtgtctcgtgagcgtcgagagaagaacccagatccattagcggagcttgatgcgattattgaggaagcgactgcgattgaaccggaagctgtggttggtctagctgatgcggttgccgatttgggtgagggcgatcgtttcagcgaggaggggttgagtcgtttgaagcgactggccactcagttgcgatatttgcgtaagtacagcttgggtcgttcggtggcggacatttttgctgatattgaaactgtgttcaatattcgcacggaggtgttgtcgaggcaggatcctcacgccgatggtgctgctggaacggtgcatttggataagttcgcagaagaggtcgcaagtcacggtggcattgggctgcctgagctgttggactattttgagctcgcgaaggatcaggaagagggccttgagccgggtgaggtgacggttcgcagcgatcgtgtgcagatccttactgtccacaaggctaagggtttggagtgggatatcgtttcggtgttgcatgccgatgcgtcgacctatgatgcgaaggcttcgacgtggttgaaaaatgtcacgatgatcccgtcgtcgcttcgtggcgatgccgggaccggcgccccagagatggatacctctgaggcggacgatcgcaaagctctggaagattccggcaaggagtacaccagtgaagtgcgtgaggggttacgggaggaaaattcgcgactgttttatgtcggtatcacgcgcagcgaacgggtgttgctcgtgacgggttcggcgcttgatgaaagtggcacaaaggcgaaagttccctacggccacttggagatccttcgggataaagcgccggagtgcgtggtgtcgtggtgggaaggggaagagggggacgtcgaaaagcaaaaacctgcggaaggcgtcttcccgcaactgctcgccgctgactcctccggcgcggatttggtgcgcggcccgcgcgccgagccaaacaacgagggcgggctggaaagcttgtgggaaaaagaggtaagcgcgcttatcgacgaacaccgccgcctttccaaccccatcgtcgaagtcgaaacgccccgcgaactcacggccaccgacctcgtctctatgaaaaacaatcccgaacagttcgcccgacgaatgcgtcgccctgtcccgttcaaaccaaacacctacgcaaaacgcggcacactgttccaccaatggctcgaagatcggtttggcagcaccgcgcttctcgacgaaaccgagctccccggcatcgacgaggactactcggatgacgcattcatcgaactccgcgacgcgttcctaggatctacttgggaaaaccgcacaccggaattcgtcgaacatcccttcgaagtaacgatcggcgaacacgtcatccgcggccgcatggacgccgtcttccacaccgatggcacctggatggtggtcgactggaaaaccggacgcaccccaaccggccccgaaatggacgcagcgatcatccagctcgctgtctatagactcgcctgggcacgactcaaaggcctcgaacctgaagaagtccgcgcagcattccattacgtcgcccacgatcacacctttgagccgaacgatctgccgactcaagaagaactagcccggctgctcagtcaggaatgatgcgcctaagatcaaacaagaatgaaaggacggtgaacaatgggccgaatgaaaaacgatggtgaactcgcggatctgccggatcatgcacttttgagcattattcgaatcccgcaggcggcgaaaagaagcccctgggcgctgatcttaacgcgcatcggatacgcgatggtgctgctggttatcgtcaccatggttgtctattttgaccgcaacggatactccgaagacctcacgttcatcgacgcgttgtactattccacagtctcgttgaccaccgtgggctacggcgatatcaccccggtgacgcaatcggcacgcctgatcaacatcatcgtcctcaccccagcacgcatcggcttcctgatcctcctggtcggcaccaccttgtcagtgctcaccgaagaatcgcgccgggccctgcaaatccaacgttggagaaaacgcatgcgcaaccacaccgtcgttgtcggatacggaaccaaaggtcgctccgcggtcgctgcactgcttgccgacggcgtccccgccaaccagatcgttgttatcgacaccgatcaagtctccctcgacgccgccaacaacagcggactcgtcaccgtcaaaggctccgccaccaaagcagatgtgttgcgtctagctggcgtgtcacgagcgcgcgccgtcgtcgtggcaccgaacctggacgatactgcagttctggtgactctatcggtgcgagaaatcgcgccgcaggcaatgattgtggccagtgtccgagaatctgaaaaccaacacctcctcgaacaatccggtgcggactcggttgtgatctcctcagaaaccgctggccgaatgctcggtctggcaacagttaccccatcggttgtggagatgatggaagacctcctctcacccgacgaaggattctccgttgccgaacgactagtcggtgaggatgaaatcggctccaacccacgacacctcgctgacatcgtcctcggtgttgttcgatccggtgagctctaccgcatcgactccccagaagcagaaactgtagagcccggcgatcgtctcctttacgttcgccgagtatttagcgaggaggtaaatgacaaatgagaattcttcccatcggcccccacgatgaaatcgccgtcaacggatcaatagtccttctatccgagcacgacggagacatcgtatcggtcggccccgacctcggcacggtgcgagttacccttgaagagatcgaaagtttaggtacaccgacggcaccccgcgatctgggttctcgggaagtcgacgcatgcgtatcgttgctccgcaaccgcgagttagtgcgattcgatccccacgatggcagtgaattaacctatcgggaacatagcgttgcttacggtgcgagtggcaagccattgtttccccgattggatccagcggtgatcggcattgtggagctgcgaggtgaggatcgtttgcttctgggcatgaatgcgcagaaacgccaacgctattcattaatcgcaggttatgtttcgcatggtgagtcgctggaagacgcattcaccagagaagtgttcgaggaagcggcgcgccgggtatctgagatttcctatgtgtcgtctcaaccatggccgatctctggttcgctgatgctgggtatgaagggcttcacggaagatgagttgcctcaaggcgaaactgatggtgaattagcggagacaatctgggcttcgccactagacattatcgatcgtaagattccgatcgccccacccggatcgattgcctacgacatgatcaacgcctgggcgcgagataaacaaaactaagggagctttttacagtgatcaatttgcaggacctcgacgaggatcaacgcatcgctgcttctgcgcctcgcggaccagtgtgcattctcgccggagccggcacgggtaaaactcgaacgattacttatcgcatcgcgcatctgattgatcagggttttgtgagcccgaatcgtgttcttgctgtgacgtttacatcccgcgcggcaggggagatgcgtcatcgcttgaatctcatggggatcggtggcgtgcaggcaaggacattccacgcagcagcgaggaagcagttgttgtatttctggcctcaggtggcgggtaatctgccgtggcgcctgttggataataagtttcaacttgtgggtcgtgcggttcgtggtgcgcggttggaatcgcagactgaaaaagttcgcgatattttgggtgaaattgagtgggcgaaggcgtcgttgattacacctgagcagtatccggatcgtttgggtacgaggacccctccggcgcccgcggagaaaatcgctgaggtgtatcagcgatacgaaaacatgaaggcaacccctgaggggatgttgcttgatttcgacgatctgttgcttcacaccgccggcgcgttggagaattccccggcggtggcggaggagttccgccagcagtatcgcagctttgtggtcgatgagtatcaggatgtgacgcctctgcagcagcgggtgctcgatgcgtggctcggcgatcgcgatgacctgacggttgtcggcgatgcgaaccagacgatttattcgttcacgggggcaacacctgaatttttgcttaatttctcgaggaaatatccggaggcaaccgtcgtcaagctgcagcgcgactaccgctcaacgccgcaggtcaccgcgctggccaataccgtcatcggccaggcgcgggggcgcgttgctggcacgcgcctggagcttcagggaatgcggatcgccgggccggagcccgaattttcggctttcgacgacgaacccaccgaagcccgcgaagttgcgggccgcattttgacgctgcttaaaaacggcgttcaggcctcagaaatcgccgttttgtaccgcatcaacgcgcagtcggcggttttcgagcaagcgcttgccgacgccggcatcgtatatcaggtgcgcggcggcgaaggctttttcacccgcccagaaattcgccaagccctgagtcaactgatccgcacttcccaacgcgacgtcgatgaaagcgatctggtgcgtctgacgcaacgcacactcgtgccacttgggttgagttcggaagagcccagcggtgcccaagagcgggaacgctggcaatcgctcaacgctttagtcgatctggtgaaagaccttgttaaagccacaccagatttggatctcacaggcttgctgctgaaacttcgggaacgccaagaggcgaagcatccgccgaccgtcgaaggtgtcaccttggcatcgctacacgcggcgaaaggcctcgaatgggatgcggtgtttcttgtcggacttgtcgattccacgttaccgatcagccacgccattaaatctggcgatgaagcaatcgaagaggaacgtcgcctgttctatgtcggtgtgacccgtgcccgcgaacacctccactgcagttgggcactcgcgaggcaagaaggcggacggaaatcgagaaagcggagtcgattcctcgatggcatagtcgtggagatggcctccgaatcgggcacacctcgcagcaatcgtccgaaaaactgccgagtgtgcggatcggttctttcaagccctgccgaaaaagctgtcggtcggtgtgcgagttgcccgatccaagcggatgaacgagtcttcgaacagctgcgaacgtggcgcaatgacaccgcgaagcgcgaaaacaaagcggcgtacatggtgttcagcaatgcaacgttgatggcgatcgctgaaatgaaccccaccaacgaaaacgaattgctcagcgtgccgggtgtggggccgatgaagatcgagaactatggcgatgacgtgctcgcgattttgggagcactttaggaacctaaactccaacacatcggacattttggatgcacagggagggtgcgtaccgagtttgttcgatcgtgggggtttacttcctccacaacgccgggcaaccatgtatcggcagtgacccaggcgacgagtcgggcagccgtcgccatctccgtgacgggatcaggaaaggtgggaccgttgggttgctgattgataatagagagccaatgcggatcgatatcgcagcgatgcagatccacacacatcaaacacggccccgatcgtgatctccggcccgggccgatgatgccacgattatcgacgatcgcggcgcacagatacgtcggcgcatatttgtgaagcagcggggatagacgttgggaatgtgcgagcttgttgagaaccaaaatgtggctggagggaagctcgaaaaactctcgaggcgactcatcgatgatctggggtctgggaacaaagccggaggtttccaaaaggaaggaggtgacgtcgacaagcgaaccgtccccgaacagcaacacctgcgccgccgccgattcgcggaccacaccgaattctaaaaggtcctcgagcaaactgctcgcagcggtgggtgcgaggcctgcagtcgtgaggtcggcgatgacatcaacgatcggtcgggcggtccgcagattccgcagcaccgggacgactcgcgacgacagcgatggatcgatatttaagacgccagcgcgggtggcgtcgatgccgaattgaatcgcagaatccgggcggatcagaacttgggcagagttggctaaagcgatgtgtgtcatctgaaaaatttcccccaaaacttaatcgacacagttacttcatctggccttatttcatcacagttacaatcatctgtcatgcaggaaaagccagagatgccagcgattgaggtcatccgttcagcgaaacgcaccaaaactgttcaagctcgaattgtggacgggcaaatccaggtgcgcatccctgcgaggatgtctaaagcggaggaagaaaaagcggtgggggagatcgtcgcaaagctaaagcgacgcacccaatcggccgtctcaagcgacgctgacctgattgagcgcgcccataagttgaacaagactgtgttggaggggcgggcgcgggtggaaagtattcggtgggtgagtaatcagaaggggcggtgggggtcgtgcacggtggcgactgcggagattcggatttcggatcgtttaaagcacgtgccggattatgtgttggatgcggtgttggtgcatgagctgacgcatacgtttattgcggggcattcggcggagttttgggagtgggcagacaaaacgcccctggcagagagggccaagggctatttggaggcgtatcagcggtggggctgaaggtttagttcttgtcggaggttccttcagaaccgtcgtcctcggaatcatcttcggaatcgtttttcttctctgcctcttccgcaagcagtttttccagggcggtgatttctgcgatggggtcgaagtcttcgccgtcggattcgccgaggagtgcgtcgatgaattcggctggtttgtcgatatcttcggcggttgggaggaagtcggggtggttccagactgcgtcgcggcgttctacccctactgcgttttcgactcggcgccacagttcggctgcttcggagaccttcggtgcgccgagctcaatgccgactacctgggagaatgcttgttctgcggatccgccggttgcgcggcggcgcttccaggcttcgttcatggcgtcggtggatgggatgcgttcgctcagggcttgggtaactacgatgtcgacccagccttcgacgagtgcgaggagagtttccaggcgggatactgcgttggcgttgcgggatccgatgcgtggggacaggtccataccttggagttcgttcatcatttcctggaggcgttcaggatctgggttgtccatttggaagttgcccatggcctcttggatgtgtgaggtgtcgatttctaggccgacggcgtattcctcaacggaggaaacgaggcgctcgacaagccacggcacgtgcttgaagaggcgttggcgggcggcttcgcgggcacagatgtaaacgagcatttcttgcggtgccacgttgaggcctttggatgcttcggcgatgttgccgggcaggacggcagatacgccgactggggagataggcaaaccgaagtcagagccggtgagggtctgctttgcgaggtcgcccagcgcatttcctaattgaactccgaagttcatcgaagacatggagttcatcaaagaagacatcgggcccatcatctcgcgggcttcttcagggaggttttctaattgggctttgttcatttgctccgcaacaggggagacaagacgcttccacacaggcagggtgttttctaaccagttttctggattccacgcttcgacgcggtgcccggaagtggggagctgggtggcgttatcgagccagagttcagcaaggcgaagggactcttcgactgcttccttctcagaatccttcaccggcgctacgcgaccaatctgctggcgggcgatgcgtgctgctaaatcataattaaccgggcctgctgcttcgggggagttcatcgaatctcccattccggacagcatctggccgaactggtttaaaatatcgcctaatccgccggggccaccagcgccaccttgtcctccgaatccgaagttgccaccgaaaaggccgaatgggtcgttgttgcggtttttgtcatcgtcgtcatcgttgttgccaaaagagaaaccaaagccattagagttcatatttaccaatctacaaggcaactatttcctattgctacgatccgaacaacgctgtaagcgaacacaggttgtagggtggatattcgtgaatcgccgaatcaagactctgacgtggggtgctatccctttggtgctgctggcatcgttggtaagcattgaccatattccgggaacaaacatcaacttgagcgtgccttatgccgctgaaggcccaggtcctacgatcaatacgcttggtcaggtcgacggcgaggatgttgtgtccatcagtagtgctgatctggatgagaccgaaggtaacctgaacatgaccactgtgtcggttcgttccggcatgacattgtcgcaggtaatttcccgatggctgtttaccgatgacacaatcgttcccatcgagcaggttttccctcccggccaatccaccgaggaagtcgaagaatccaaccgcaccgcgttcatctcttcggagtcttccgcaacgatcgccgcgatgaattacctcaacattcccgtcgaagttgaagttgcagaagtcctcaccgacagcgccgcaaccggaattttcgaacccggcgacaaacttctcagcatcgacggcaccgcaatctccactcccggcgatgcacaaaccatcgtgcgatcgaaagctcccggcgatgagatcacgatttcctacgagagaaacgatgcggaatctcaagcaaccatcactttgagggaacacccggatgattcttcggtggcgttgttgggtatttcaatgttgtcggtgccttcgagcgcgattgaggttgattacaacttggaagatatcggtggtccgagcgctggcatgatgttttcgttggcggtcgtcgataagctttcgcctggcgcgctgaatggtggcaagtttgtcgctggcactggcaccatcgcggaggacgggtcggtgggcccgattggcggtattgcgcacaaggtgcgcgctgcggaggacgcgggcgcggaagtgtttttgagccctgcggacaattgcgcggaggcgatgagtgcgaagcctcaggatatgacgatcttgaaggtggattcgttgtctcaggcaatcgatcagatggctgcctacaacgagggctctgatttccagacgtgtggctagtttttagacgctgaggtttcttccgaggactcttcagtgtccttcggtgtcgacagcccaagttcgtagatgcgttcctccggatcgattttgtcggaggacaccatttgctgcagcactaggccttggtcattatcaacgaccgtgataatcgacatcgtgccaatcgtggtccagcccacaaccttggatccggaatcctcaaccacgcgtgagctgcgcagttccgtgagcagctgcgtcgtgctcgtggccttcgacgcattgtcaaagaattggaattggccaacttccggcccgttgcacgcgaaggaatcctcgacccctgacgggtcgcaggtttcgaattgctcaaaaagctcgacgggcgcgagcgaggagaaagctttataggcgacttcaacgtccttggtcatacgaggtttgcttgtcgacgtctccccactctctttcgtcgacgtttcggcagtgcttgactctgtcgtttcaattactgaagacgaagcagtggtagcaggagttgtcgttgcttccgttgttgtcgcaggagttgtttctgccgtggattcagtggaagtttcggtggatccgccgcccgtacatgcagctaaaagaggaatgagcgccactaatcccagtgcaacgcggacatgcttgtgcggggtggacgccacagtgtgaactcctcaaataaattgtgggcggggttaacttaatttatcctagcgaacctggacgaaaagtcagtttttagatttcgtctgggtccgcttcgagggtgtagcgcagtgctgcgattacacccggtgcaacccctgggccgccgcgcagttcgatttcatcttcagcaaacggtccgcgttctgccaattcctcttcggtggggcgaagctgcagaagggtgagttctgcttcgccgcgcaaaacgccggaaaaaagacgagcgggtcgtggttctgagcctgcaacggcagcatcggtgaacataatttcctgagccaacaccgcgccggcaatctctgctggccacgccaaacgggacacatagtcacctaacgcttcggaacctggcagcaagttgtcagggaggttgtcctgtacaacaagggttagtggggagtcgtcagctgcctcatcaagagtatccaccagcatttcagtggggaccaatgcgaacagggtagggccggcgtcccaaccttcggcgtggataaactcgacggcttcgagcatcgctttattcagtgcttggggactaaaaatggaatcgttcataattttttccttttgtgaactacttgttggcctttataggtgattaaaccgtagagtgggggagaaacgcataatcacgtacatataaggatattgtcttgtcgactggtctcacacctcctccccaaccgatcaagcgacctcccaaggcggtgacatggatcttcgccattatcgcgttggtcattctcatcgccccaatgagtgttggcttctataccgactggctttggttcggtgaagtcgatttccgaggcgttttcagcaaggttattgtcactcgcattgttctctttgtgatctttgcgctaattgctgggtttgtcacatggcttgctggttattttgtgacaaaacttcgacctgatgagatgtcggcgtttgatacccagtcgcctgtgtatcagtaccgtcagatgatcgaaaacagccttcgtcgcgttatggtgatcattccaattttcgtcgcgttgctggctggcctaattggtcagcgttcgtggcgcaccgttcaaatgtggctgaatggccaggactttggcgtttcggatcagcagttcggcttggattatggattctacgcgtttgatcttccgatgcttcgcctcatcgctgactcactgtcgatgatgttgatcgttgctttcctgatcgcactcgttggccattacctcatgggtggcattcgcgctggaaaccagatgacgggccagaagtcctttgtatcccgtggtgcgcgcactcagcttgcggtaactgctggtctgtggatgcttgttaaggtcgctggctactggctggatcgctatgacctgctgactaaggaaaactcaaccttcacaggtgcaagctacaccgacatcaatgcacagctgccagcgaagatcatcctgctggttatcgcattgttcgtggcgatcgcgttcttctctgcgatcttcctgaaggacctccgcatcccaggtcttgccgtagttctgatgctgctgagctctgtgatcattggtgctgcttggcctttgatgctggagcgtttctccgttcagccaaaccgtgcagaaaaagaagccgagtacatttctcgaaacattgaatcgactcgctatgcctatggcatcaccgatgaagatgtcacctacgaggaaaactggggagcaggggagaccaccaatgaagaagtcgccgctgattctgcaacgatttctaacattcgtctgctggatccacagatcctgtcaccaaccttcacccagcaacagcagctgcgaaacttctacggtttcccagaccagctggcgatggaccgctttgaagtagatggcaaactccgcgactttgttgtggcagcacgtgagctcgatccaaacgccctgcagcaaaaccagcaggactggattaaccgtcacactgtttatacccacggcaacggcttcattgcagctcaagcaaaccaggtggatgaggtcgcccgcgacgtcggatccactcgtggtggttaccctgtctacaccgtctctgatttgcagtcgaatgctcgtgctgcagaaagcgaagatgctgaggagcttggcatcaaggttgatgagcctcgtgtgtactacggaccactgattgcttctgcgactgatggtgctgactacgcaattgtcggtgacaccggcgatggcccagtcgagtacgacactgacacctccagctacacctacgaaggtgctggcggcgtggacattggaaacatggtcaaccgtgcgatgtttgcattgcgctaccaggaaatgaacatgctcctgtctgatcgtgttggttccgaatccaagatcctatttgagcgcgatcctcgttcccgtgtggaaaaggttgcaccttggttgaccactgactccaagacctacccaactgtgattgatggtcgcatcaagtggatcgtcgatggctacaccaccttggatagtcttccgtactccacgcgcacctcactgacggaagcgactcaggatgctgtcatgcctgacggcaccccacagccactgatcacagatagggtcggttacatccgcaactccgtgaaggctgttgttgatgcgtacgacggaactgttgaactctacgaattcgacaccgaagatcctgttctgaaggcatggcgtggcgtgttcccagacaccgtgaaggacgggtcggagatttccgatgagcttcgcgcacacctgcgttacccagaagatttgttcaaggtccagcgtgacatgctggccaagtacaacgttgatgattctggaacattcttcaccaacgatgcgttctggtctgtcccaggtgacccaactgcagcggagggccgccaggaacttaagcagcctccttactacgtggtggcagcagacccagagaccggtgagtccagcttccagctgatcaccccgttccgtggacttcagcgcgagtacctctctgcacacatgtctgcgtcgtctgatccagttacctacggtgaaatcactgttcgtgtgctgcctaccgattctgtgacccagggtccaaagcaggcccaggatgcgatgatgtcatctgaccaggttgctcaggaccaaacactgtggcgtggatcgaacgatctgcacaacggaaacctgttgaccttgccagttggtggcggagagatcctctacgttgagccgatttactcgcagcgcaaggatcaggcatcggccttcccgaagcttctgcgcgtgctggtcttctacaagggtcaggttggttacgcaccaacgatcgctgaagccctatcgcaggtcggcattgatccgaaggaagcgcaggacatcgaagaggtagatggcaccgctacgacgccatcgactgatgagactgacactgacactgatcagcctgcaaccgaaaccccaactgcaccagtgagtgaggcggaaggaatcgcggccatcaacgatgcgttgagcaaccttgaagctgctcgcgatagctctttcgaagagtatggtcgtgcactcgatgcgcttgatcgtgccgtcgatagctaccagtccgcacagtagcgtttgagtaaacagcccgagaggatcgttcctctcgggctgttttttctttagcctagagacaccgcatcgctgatctcagcaagcacccatctgagggtgtcttcgtcgtgggagccgaagccgaagacgatgccgttgtctgcgccggtgccgccccagtagtgggaaagcgcggtgacgttaaggcctcgggaggcgagtgtggtgacgacgaggtcttggggtttgtcgcaaaggagaactgcgtggaggccaccgttgatggggcgaagctgcgtattcgggaggtcaccgagggtgtcttggacgatggagcggcggtgtcggtaaaggcgccgcaaacgttgggtgcggcgtcgtaaagcgcctgaggcgaggtaggacgcgagcgcgtgttgggtgatggcgccgactggctggccgagaatcccgcgaagcgtggcgagcacgcgcgcctggggcgtcggcgcgatgaggtatccgcaggcgacttgtggtgtgatcacggaggaaaacgtgccgagcagaatcgtgcgatcgggcgccagcgcacgcagcggcggaagcggcataccgacgtagcgcagctcagaatcgaagtcgtcttcaataagcaacgcatcgtttgcctcagcccacgcgactagcgcggtgcggcgatcggcgggcagcgagccgccgtagggatattgatggctaggggttaccagtagcgcgttgaggtcgtggggcagcgcgcggggtacgaggccggattcgtcggtcggcacatcgatcgtctcatggccaagcacctgcgggatgcggcgcaggctggggtagccgggcgattcgacgccgatgcgggcaggcgcatccatggtgcgcagcagcagactcagcccctcgcgcgcgccggcggtgacgatgatctgctccggctcgaccatgaggccacgcatctggcgcaggtggtcggcgatctcgatccgcagcctcaaaagtccctgctcaggggagtgcgtgggtggcttggcgcaggcttcgcgccacgcagcgcgccatgcggaatcggcgagcgtcgcggtatcgggcacgccggggctcaggttgagcagcgggggcgggacgcttctcgacgtctccttcttctcaatttccacaggcttcaacaaatgcagatctgggttgatcgttgtaccggaaccgcgggcggtgctgaggtagccttcaccggccaattggtcataagcggtcaccacactgccgcgggatacccccaattgggtggatagtgagcgactgctgggaagcgggtctcctggggtgagaattcccctcgccacgagacgacggatctgttctgtgagctgcgtggggatggatgttggttcgtgtgggtttaaggcgatgggaaggtcggcaagcatggcttcatcgtcctcaaaaaagtggtctaatgcaagtgactgaaagtggatctaccgctagtccactttgtggcgttggatcatctgtcatgaccgaaactcaagaaacttaccaagcaaccactcgtgtgaagcgcggccttgccgacatgctcaagggtggtgtgatcatggatgtggtcacccctgaacaagcgcgcatcgccgaagatgcaggtgccagcgcagttatggcactcgagcgcgttcccgccgatatccgttctcagggcggcgttgctcgcatgagtgatcctgacctgatcgaaggaatcgtcaatgcggtctccatcccggtcatggcgaaagctcgcatcggtcacttcgtggaagctcaggttctggaagctctcggtgttgatttcatcgacgagtccgaagttctcagccctgccgactacacgcaccacatcaacaagtggaagttcgacgttcctttcgtctgtggcgcgaccaacctcggcgaagctttgcgacgcatcaccgaaggcgctgcaatgatccgttccaagggcgaagccggcaccggcgatgtctctgaagctgtccgtcacctgcgcaccatccgcggcgacatcaatcgcctgcgctccctggatgaggatgaactcttcgtcgccgccaaggaattccaggcaccatacgacctggtccgcgaagtcgcctccaccggcaagctccctgtggtcaccttcgttgcaggtggcgtcgcaaccccagccgacgctgcactcgtgcgccaaatgggcgccgaaggcgtctttgtcggctccggcatcttcaaatccggcaatccagccgcccgcgccgcagcgatcgtcaaggctgcaacgcttttcgacgacccctccgtcattgccgacgtatcccgcggcctgggtgaagccatggtgggcatcaacgtatccgacgtcccagcaccacaccgactcgccgagcgcggctggtgatcgttggagttttagctctccagggcggggtggaagaacacctcaccgccttggaagctctcggagcgacgacccgaaaagtacgtgtgccaaaggaccttgatggtctcgaaggcatcgtcatccccggcggggaatccaccgtgttggacaaactggctcggacattcgacgtggtagaacctctagcgaatctcattcgcgacggcctacccgttttcgctacctgcgctggcctgatctatctggcgaaacacctcgacaacccagcaaggggacaacaaaccttggcggtagtggacgtggtggtgcgtcgaaacgcatttggcgcccaacgcgaatccttcgacaccaccgtggatgtttccttcgacggtgcaacattccccggagtgcaggcctcgtttatccgagctcccatcgtcactgcttttggtcctacggtagaagcgatcgctgctctcaacggtggggaggtggttggtgtacgccaaggcaacatcatcgcgctgtctttccatcccgaagaaaccggcgattaccgcatccaccaagcctggctggacctggtgagaaaacacgctgaactggcgatttgatgttttcggtagcgctctgtatagtttctactcgttgcacagagcgcgaaagcaatcattgcaaaagattagatggttttatgatcatcgcgtcgcggggtggagcagctcggtagctcgctgggctcataacccagaggtcgtaggttcgaatcctgcccccgctactaagttaaaaatcccctcaacttcggttggggggattttttcattcctatctatatgactgatcgggccgcgttgttagcgactctcgtggctaagagcaagacagcaacctcgcacagcattccggccaagtcagagagaataccccagggagtaccgagagctagttcggtagcaattgcaattggggtcgttatcgctgcgacccatccaatcgtataaataagtggcaatgcagcggagtgtccctctttccaagcagcgttggaagcttgagtgtggcgggagcgaattcctgccgagctatgcctatctaatttcgcctgtgctgccatgcgtgtcattgaaatgcagacaactgctataaggactaccgaaaatagcatcagtacaacactgcctagacttgaatccatgaggagtccttctcattgttttcttgaggataacacgtgtgggaatacatatcttggtgttgcggtgcaggcggaggagctaatctgcttctgaatgtggacatgacaccaataaatcattacccctaaatgggggattatgagaaatggggctactttggcatttcgaggcgggcgtgtatctaaaagatggagtttccccagttcaaaagccttaatgtatgaaaatattcggtatttcacagccctttcctaacgtagcctttgagcgtatttcggaaaatgaagtgaaatttctcccagtcagaattacctaggtcacacttcgaattttagcaagcaaaagttacctagagcgtggcattatgtagtgcattgcccttttgctgttatgaaagtgaactaaagatatctatgcgcagaccggtctcacgccgcgccatttttgcaacatctgttttggttgcgggggtgagcatcatgtcaccttcggccaacgcagctgaggctccggcatcggaatgggtgaatacgacagcgatcgtagatcaagcgaatgctcagttgtcgcagtttggcgtgagtcttgaccgaagtgcagcagaactttttgatgatcaggcaaactcccaaattgatgcagcgctttcaccgtatgccgataaggttccaacctctggcggccaggtagtcgagcaaagtcttcaggttgtggagcaggaagttcaaaaggcactgcccaactatgaaatccgtaccgatctgcaatcccaggtgatgggtgcaactctaggagaggtgctgcaccgagttcctggatcatggtttgatgcgccagcagttcctgaagaatccaggattgtagaggaacagggtaaatccctgtatgggcccggtaccccgatctatctcaacggaaattccatgtgcacgcttgcggtgactggaactgatgcagatgggcgcaagatcggtatcactgcaggtcactgtggaaaatcgggcgatgcagtccgttcggctgactccttctgggtcggcgataccggaacagtggtgtacaacgcgcctaacgctgactactccgtgatcgagttcggttccaatgcagagttgagcaatacctacaacggtgtcaccgcgaatgctgtcggcggtggcgtgactaatggccaagaagtatgcaaaaacggagttgctactggctacacctgtggtttggtgtggactgctgatgagcgcatgacgatgtctcaggtgtgtgcgggtcgtggtgattcgggtgctccgctgattgcagatggtcgtgtggttggtcttgtatctggtggtgtaattcctgattacaacctggcatgcgccactccgttgcagggacctttcttcatgccaacgctgtcagtgaacatggatactgtcctaactgatttggattcgcaggatcttcccggtcgaggttttcagccaactgctggatagaatttagaaaatccgccgttccacacaaggaacggcggattttttgatgactaagtgagtttggatgcggaagatttgggctatttccataaatcgaaccaggtgaccgagagttagaagcctggagaggacggttcgcttggaatctttccccttgttcgagggtcctgccttttatctgggtggtggagttatgaaaaacttgcgtattagaccaagagccgcttttttcggggagtctttggtctccattgactctgtgtcggagccgaaaaaagagcttggatcgcttgtttaaatctaagcttcgtttagttcttgccgggcactttttgaacgcggatccatcggcgatggcttcaattttcgatgtggattttgaatctggtgttattagttccgtcattagggcacgtgagcttacgttggatgacttctctttgggctgtgttacgcctttggttgcttttgtgggttgggagtttcctcaaggggttgagccgtgtttaccggtgaaggttgagcagtcgatcatttatccgcgtactagtgagggggtaggtgcttctcaaggtgaagggatgggtgatgctgattttgaagggttctctggtgcgtggtgtgctggtctggagctctacctggctctgaagctgggtgctcgtgtgacatgtcagatggggtattcgctggaaggtctcactcgtatggtcagccctcgatgtctttacggtctgcgcttcggcaaatggtaattgatcgatctgctgctaaagagattttcggtagagggtctttggaagagctcacgattaagattgcgacgaatgctggttatgggaagctctctcaagatgttgctcctcgttcaggctggaatgctttcgaggagactatggagtctattggtggttctgcggttactagtccttatcatgctgccatgactacaagcttggttcgtgccttgcttttggctatctcaaatgagattgagattcttagtgttactactgatggtttcattaccagggaatctaacattgaggctcttgagtgttgtggcattgctgatgtatttcgtgattcgcgtggtgcgctgacaggtgaccggacggtgtgggagatcaagcatcttcaagatgatttgctgaatttcacaactagcgccaatatctcaccttcatatgaaggtggaggatagcgaaggtcgagttatcgaaaagggtggtgtgtgcgctaaaggtgggttgaaacccccaaaaatataaagcgtgggagtttagaagagcgggtgtggtttcgccacgccgtgctttcacacataggtaaaattaataatccttatcatagttttccttcgtttcgtgagctgtcgtgctctcacaaccgtgttgacttcgtcaaaggatcacattcaccgtagatttctctggattacgattttcaacggatgtcattgcaagaatttgtagttgttgattttattgatggttttgaagtagtgggtttcaagactgttgcgtgggactctgtgaaggactaccaacgtgcttgttatattgctgatcatcgtccgggtaccactgtggtccagatcgtcctagggggttgattacggatcgaacacgattggactcattggtttgagagatttaacagtgaggaacatcgtcgtattcgtactgccgagtctgtgcgcttgactaaattggttgctggccataaagaggtcaggtggaatcttccagtgttgtcttcaaaagctagtgtggttcaggtctttgggttacggggatttcactcgagcacagtgggaccatatgagtaaaagcgaggcgtaaggacgttctcaagggtattgacattggtggtggatgctttgattgctcaaacttgatgtgtatctcttgacattagaggctgttaaaaaagatcatgaagattttctttggcgtttagcgctgtgtgtaatctttggttttgaattgtgggtcaccgattcatcagttgaagttttttactgatggaacggtatttttatgttgatgagattctgctagtgcgggaaatatgcaagatctgacaaataagtacgggggcatcgcaagacttttaattactatttaattggcaccttgtagatacgtgagtcggcgctgatggacgtgtccgttactttggcttttcgcagaagccgagattgtggccggtgtgacagcctatattgcgctagatattttggtgctgcatacgatgatcacgtcgctatgacgcaacgccattcgtgatctgtgttctggaacttatgcgtgattttcctgcacgagcaatcaaagactgcacctagctggagttcatagctggaaatgaagaaaccatttgcttctgaagtatgtccgcactcgcttagctgatgtcatccaatgtagagaagttcaaaagctgaagcaggggagcacaattctacttcgctacaggaaaatctccattcaagcatccagcacacaagggctaaaaagtcagtagccaaaagttacctttctcgcgtgatatgtgccatgcccggaacgggggtaaaaatacacgtaaaacaattttatgcaaagaacttatagtgttttcaggttagggtcagatcattcacatcaactagtaacgaaagggttatgtgaatgaaactgttttctcaagctgcaggtatcatcgccgcagcgctccttgtcacaggtggtatagcgcctgtggcacaggggcaagcgcttcaggtggttacacctgagcagcaagagtcctatgtccaacagttccatcacgacggtgataccccacctgttgttgatggggttggtggctacaccgagcaagaagtcgccgagattcatgaggctatccgtcaagcccaagactctggtgcacctaatgatgaacttattcctggtgagatgtggtcagataaggtcgagttaccctcaacgattgataaagcagctgctgatgaagctgagatagctattgcacagcaacagtcccaaccccaggcgagaggactagccgctgctgcagcgtgtcagacattttggccgtcaccttatcaagtttgtggtgctatcttagagcgctatatccagcagggtgcccagtttgggtggatgttgttgcttactgaaggccaagcgcttaaccctgatggtcagggatatcgtcagcggtttatgaatgggtttatctattggcatccttctactggtgcgcacgcggttaataattacagtgcacaagtctgggagcgtaacggttgggagtctgggtggatggggtatcccactggtggtgaagtccctgtgtctgggtctaatccgattgatggtgagttgagtgggtgggtgcaaaccttccaaggtgggcgagtgtatcgcagtccggtattggacggtttccaggtggccagtattaatgggctgatcttggataaatggcttgaattgggtggtcctgatagtgaccttggttttcccattgcggatgaggctgtgacagctgacggtgtgggtagattttctgttttccagaacggagttgtctactggcatccgcaacacggagctcaccctatattagggaatatatacagtatctggagagaagaaggagctgagagtggggaattcggttaccctatcggcgatccagaaaagtatacagaaaacatggctaatcaggtattcgaaaaaggcgaacttgcagctaacctataccccaatcctcttgaggcttttattgagtttttaccctttgctaatcttgaggaagcaatagagtattttgagaacggattgtcaaattctcgtgtagaggcgaattcacttaacgccaagaaagattcgattcaatgtcaatcgcaatccgctaacattcatgtgagaacgaagagtgacggagtcgggattagggttccaaagattgggtttaaggctaggatggattgcgaccttcctggaactgtctcagatgtagtggggtatggatggatttactacgactattggggacgatgggctcaagcagcatatgcacaacaattcttcggtaataggaattctgttgtgcaaaccaatttagaggcgggttgcagcggggagaagaatacattattttggggtacttcatattttcaggtgacttatgaaggtcagccgtatttcggtcagtcagcaactaactacgcttatcttccgtgtacgatagaccgtagttaacataaggaatggaataggagaattgcggcatgtattccgacaagctgattctcttgttcctttctgagcaggattcaagctatgaatgctgcgtaggtttattagatggctcagatggacttgattatattgaaaagcttctgaagggtaggaagctgaagaaccattttcttgaatgggaagatattaacaaggctgatgttgctcgtgaagaaatatataaagggcaattggtgcatctggtgtttgtgacggctctttccacgcctggtgaaatttcttttgtttttccaggtcaatctcttatgagtgcaacactcgaagaagactttgctgcgcttgtgctcgaagaggagcgcacatcatttagacctgaactgtctcacctgtggtcactccccgtagggtgggtagctccggggcttgagggtttcgtggagcgtaattccgaggcagcttgaaccaccgctttctgagccggaaacctcacgcgataatggcatcgaaagacaattgattcatgctgaattcagagatctacaacctgttgcgatagtccatctcacgatgtgcctagtgtatgagctaataaagcttagacctctctgcatccctgatagcactttcgtagttatcagatgctattttgagctagaagtggatcttatctaccagggtgaaagccaaacaacgctgtacctttctttgctgatgggtgcaacgaagacggagttatgatgaaggaacgacgaatcaagactttggcagccttagtaatctgcggcctgactgtttcaggatgcggcaattatttgggagacattaatgtcaaagggcgcgctggtttttcagtatctgaagcaggtgatctcattgttcgtgtacaaccatgtgggttgcctattgatacagtagacatggccggcccaatgccacaggatcaaccaccccaagcaaacccggtgtatcttcaattgagtgatcccgacggtcgtactgatcctttcatagtagatcctgaaaacttagacccgagctgggcaattatagcaggtgacggcctgccaacagatcctgatgcactcatcatcgttaatgcgcatgtcgagggtgagagtactcaaacctcacaggtgtcagcgtatgttagggatgttcaggggttgaggacagatcaaatctatgtaggtacccttgaaagctcacgaatagttgacgagagtacttttcttcattgtcgcaagtagcgtgtggatcactgctgacgttgaaggtcaggttggattgacgcgtgcaagtgacggagcgatctcaatcgtggtccaaccatgtggccttgagatagacatggttgcgattaaaggacttctcatcttgcagactattgaggattttcaccagtgcagcacacccttgttgatgagagtagcgatgtagtttagtgtcgcgtaagtctttttcaatcctgaaaacaacaccccgtactgaatttatgcagtacggggtgttgtctgcgtgaataccgatttgtgtcatatctagagcactatgcgtggagggcggatcgctaagcctcgttcaacatatgcataggacaacggttgatagccgttgtccgtatggaatccaccgttgaaaatgtattccataaaaattgtgccttcattactgagaaaatccgtatcgcgattgagtatctcgttgaccatgtcgattgagtctttagttgaaaaaatctctgcgagctgttcaagctgatcgtaatgaggtacaaccctaccgttgttgatctccttaaattgctcgcggatcatgatctcttgtcgaggagtggtgcacatatcaatcatgtcttggaggtcgcgctcgttgagtgtcgtcggttgctgtagttcttgttccggctttggtgctgacgatgtagctatgtgtgtagcttctgtgcgtctttttttcagctctgcgttctttccagttatttatagatctaggaatcactacttcaaacaggtgattgacgcccttttaggttaattgatttagtgacgtcacctattactgaagtcgcaaatgaattgagttttgatgggcttttaactagacgcggttcttttactagctcttccagcgttccattttggtgtcgcacgccccagaacttaaggaatcgttagtgactttgttgccgtttttttggtgatttttgagacgtaaccttcaatcttttgaagattcgaattattttcgagaggcatgcataaaaaatatatcgtattgtcgatattattgggatgttcagacatattcggagccgaaatatacgttggaggccaagactcggattggcggggtcggttttggtcagatatgacagtcagcctgcaattactatctggaactctagaatcagggtcctctcaggatcgtatataagaggctgaaatgcttcaattatacctctctgagaaatttgatccttataaaacggctcctgtgctctttgtactttctgggtagtggggttgaggaaaattcgaccaggtggccgaaagatccaccccaccccagacgtcggtcaaataggacggtatccggaaaaccaagcaaaacccgggagtctattttaaacgatccagcgtctcatcgtgcaggatgccgttggtggctactgcatcgccaccgtgtggtccatcgacgccagccagtgaggtgaactttcctccggcttcggtgaccaggatggacaggggagcaagatcccagaggctgacttctggttcagcggcgatatcgacggcaccttcggcgacgaggcagtaggagaagaagtcgccgtagccgcggagtcgccaggtggtatcagttagggagacgaactgatcgcgcaaatctcgttcggcccagccggagagggaggagaaggagagggaggcgtcgtcaagcttggacacctgggacacggacagtttgcgtggggagctgccgttgaaggtgcgccatgcgccggccccttcggatgcccaccaacgcctagccagtgcgggtgcggagatgacacctgcgacgggtttgccgttgtcgagcagcgcgatcagggttgcccatacggggacgccgcggacgtagtttttggtgccgtcgatggggtcgatgatccactggcggccgctgaattctacgtcgccaccgaattcttcaccgaggatggagtcggcggggcgggcggtggcgattttctcacggagtgcttcttcggtcgccaggtcggcatcgctgacgggagtcatgtctggcttggaggatacttccaggtcagaggcttcgaagcggtcgagggtgatggaatcggcaagttcggcaagttcgagggctaaggctaaatcgtctgcatatttgctcatgtgttgttagtctagtgcgcttaaagtttcggagatctcactaactgcttccgcgtttcctgcaacggaccattcgacgccgccggcggtcactttgatgcatgctccgccgacgccttcgatgagtgcgcggccgggtagccagtcccaatctgcgacgctgtgctgcacccatgcgccgatgctgccgtcggcgatgttggccaaatcgatggagccggcgccgaacatgcgcagcgttgcagggtgggtggcaacgctcatccacgccttttgaatatcaggttccgcgatgcgtgacgggtggatgtaggtggccagggagatttgattgaggggggcgtcgacaagcaaatctagctccttgccgtcgagcgtggtgcggattcccgggccaccgaaccacgtataacccatggctgggcggtgtacggcgccgaaaagcacgcgcgatggcgcggatggatcgccctcgaccagcgcgagcgccgagcaccaataatctgagccctgggtgaagttgtaggtgccatcaaccgggtcgatgacccaggtttttccgcttttcgacgcccggtccgcgccttcctcgccaagcacgccgtcctcaggccgcaacgcttcaagaacgcctgcgacgaaggcctcggccgcacgatcggcatccgtgaccacatcagacacagaagtcttgtaatccgtatccacaccgttttcgcgcatgcgccatgccaaacgtccagcgttgtacaccagtgcctgcgcaagatgctcatcagaatcctgatcgtgagcaatcacgaaggtctttgtgatggttttgatcatgtcttcgaggcttgcagcgggatgtgtctgctctggattagtcatgccttccattgtgcatgccgtcggccaagtgtgctgaataaggtggcgttctaagaatcacaatcggtgcgggtaatatgtgcaatcatgcgtcccgaattttctgcagaactctccgagctagacagcacgctgacaaccattgaaaaagtgctgaacccgcaagagatgtctgaccgagtcagagaacttgaagctcaagcagctgacccgtctctgtgggatgaccctgaccatgcacagcaagtcacctctgagctgtcccacgtccaggcggagctgcgcaaaattaccgatctgcgccagcgcatcgaagatctgcccatcatggtggaactcgcagaggaagaagacggcgatacctccatcgcggaagaagaactcgccgatctgcgttctctgatcgatgcgttggaagtaaagaccatgctgtcgggtgaatatgatgctcgcgaggcagtgatcaatattcgatccggtgccggtggtgtcgatgctgcggactgggctgaaatgctcatgcgcatgtacacccgctgggcggaaaagaacggccacaaagtagatatttacgatatttcctacgccgaagaagccggcatcaaatccgccaccttcgtggtccacggcgactacatgtacggccagctctccgtggagcaaggcgcacaccgcctcgtgcgcatcagtccttttgataaccagggcaggcgccaaacctccttcgccgaggtagaagttcttcccgtggtggaaaaagtggactccatcgacatccctgatgccgatgttcgcgtcgatgtctaccgctcctccggcccaggtggtcagtccgtgaacaccaccgactctgccgtgcgcctgacccacatcccaaccggcatcgtggtgacctgccaaaacgagaaatcacagatccaaaacaaggcatccgcgatgcgtgttctccaggcaaaactgcttgagcgtaaacgccaggaagaacgcgccgaaatggatgccctcggagctggaggcaatgcatcctggggtaaccaaatgcgttcctacgtgctgcacccttatcaaatggtgaaggatctgcgcaccaactttgaagtcaacgatccgcaaaaagtccttgacggcgatatcgatggccttttggaagcaggtattcgctggcgaatggctgagagccagtcggcggaataaaggttggttttctggcagaatctggcgatttcttaagaattaccggttatttgtcgttgagttctcctctgagcactcagggtagtcacttccgtttctttagccacaggagtttcgctaaagtgtgacccgtgatcaccttcgagaacgtcaccaagaactacaagacatcaacccgccctgcattagacaatgtgtccctacacattgaaaaaggcgagttcgtgttcctcatcggcccatccggctccggaaaatcaaccttcctgcgcctgatgacgcgggaggaaaacgtcagctccggatcgctgacactggctgattttcaggtgaacaaacttcgcggcacgcaagtaaacaaactgcgccaacgcatcggatatgtgttccaagatttccgactcttaaaaaacaagaatgtctacgacaacgtcgcattcgcattggaggtcatcgggaagaagaaggacaagattcaagaacttgtccccgaaactctggaaatggttggccttgccggaaaagccaaccgcatgcccaacgaactatccggtggtgagcagcagcgcgtggccatcgcccgagctttcgtgaaccgcccactcgtcttgcttgctgatgaaccaaccggcaacctcgaccccgatacctccgatgagatcatgattttgctcaaccgcatcaatcgcctcggcaccacggtggtcatgtccacccacaacgcccgaactgtcgacgacatgcgcaggcgagtaatcgaactgcaattgggcaaactagtccgcgatgatgcccacggcgtctacggcgaaatgcgataggggagtacttcacatggcttttggatatgtactgcgtgaagctgttcgcggcatgggccgcaacgtcaccatgaccatcgcgctcatcatcaccacctctatttccttggcacttcttgccactggatttttggtgaccaacatgaccgaccgcaccaaggacatctacctggatcgcgtcgaagtgatgatccaactcgatgaggacacctctgccaacgatcccgaatgcaccgcggagtcctgcaccgaagttcgtgatgtcttagaaggactcgacggcatcgattccatcacctaccgttcccgcgaggcctcctacgaacgattcgtagaagttttcaaagatactgacccagttctcgtcgctgaaacctctcccgacgcattgccagcagcgttccacgtccgacttgaagatccacttgccgttgagattctcgatccggtccgcgatcttcctcaagtaagcaacgtgatcgaccaggtggatgatctgcgcggagcaaccgaaaaccttgactccatccgcaacgccaccttcctcatcgcggctgtgcaagttttggcatcgatcttcctgattgccaacatggtgcaaatcgctgcattcaatcgtcgtgaagaaactgaaatcatgcgcatcgtcggcgcatcgcggttctacactcagggaccattcgtcttcgaagcgattctatccaccctcattggtgcggttttcgccgtcggcgcgctcttcttgggtaaagaactcgtcattgataaagcactccgcggactctacgattcccagctcatcgcaccagttaccaccacagatatttggctggtcgcaccgataatttccggcattggcgtggtgatcgccggcattatcgcacaactcaccctgcgcttctacgtgaggaaataagactattgaactccttgccgtagacttagaaagactatggccaagaagaaaaagaaagtcgacgaaaacaactcagttctcgcgaccaatcgcaaggcccgccatgactaccacatcattgatacgtgggaggcgggcgtggtgctcttaggcaccgaaatcaaatcactgcgcgaaggtaaggtatccctcgtggattcctttgccaccattgataacggagaaatctggcttcagcatctccacatcccgcagtattccatgggctcctggacaaaccacacgcccaagcgcacccgcaaacttttgctgcaccgcaacgagattgattccctgatgggtaaagtccgcgacggcaaccgcacgttggttccgctcaagctttacctcaaaaacggtcgcgtcaaactcgaactcggactcgcacaaggtaagcaggattacgacaagcgccaagatatcaagcgtcgcaccgaagaacgcgaagtcacccgtgagctcggccgtcgcattaagggaatcaacgcgtaaatgagtattcacatcgcaaaagtccacgacgtcctcaaaggtgaaaaaacctacggaaccaccattttggtggatcggctctggccacgcggtgtgaaaaaagacgaccttgagccagacctctggctcaaaagcgtcgcccccacaaccgaactccgaaaatggttcggccacgacccagctaaattctccgaattcagcacccgttacaccgaagagctcaacgccagcaacgacaaagacctagagacgcttgtcgacgccacctcccgccaccccgtaaccctcctctacggtgctgccgaccgcgaccacaaccacgccattgttctagccaagtggctaaagaaataactccttgcaaatagttgcaaacttaagttatgatgaaccatcttgtggaactcgcacgagcccaccacaggaatcagtaagaatcaatggggctgacatggtttcgactacgttgatttagccaggggaagcgtgccggtgaaggctggagaccaccgtaagcgtcgcagcaaaccaataagcgccgagaagtctcagcgcgactacgccctcgctgcataagcaagcgaccgcgtgtctgtcagcctagggaagtccctgacctagatcctggcatcgactaagggacttgctgttcaatcgcgtcagcggggttgaacaggacttttaccgttgactgggctcatcatccggaagtgttcgtcctagccggagggccaagcagagatctttgcgcgaactgcgcacggagaagccctggcgaggtgacgtaggacccgggttcaattcccggcagctccaccgaaacgaagttccccacaccatctggtgtggggtttctttgtttttcactctcataaaaggggaaaatgtcttcctatgcgtacattcgccagcaagatttggtcaaaatcaggatatcttgtggtctaatgcaccatggggtagaaggaaaggcgggtaagagattgcgcggataggaagatacagggggccacggtggggtggtgaacaagagcaggcacgaggcctggtagatacggattcgaccaagaaaacgtacaccactcaggagcactcgtgcttgcccttccatcctctatcatcgaccccctctggtgccagttcgccgcgctgatcccacccgtgaccgacacccacccacttcggtgccaccgcccacgcatcccggaccggatcatcttcgacaagctcatccaggtcctcgtcctcggcgcctcctatgccaagatcgccgacacgacatgctcggccaccaccttgcgcacccgccgggacgagtggatcaccgctggcatcttcgagcagctggaacagatctgtttggaattctacgaccgtatcgtcggactcgatctctaagttcggattggctcgaattgtcgcattgtgcgccgactgaagcgccctgtctatccctacctggtgccgaaaaagttgctcggtgagcatcaaacggctaggtgtccgtcgtagagacaggttttcttagcgattatcttgaagagaatgtggctactatccatgctagttgtgttgcggagctgtgggaattgaacccggaacctcggttttccactgggaattcgccaataattggtaaaaaataataatgggtgtacagtgatcatcgaagcaaacagcgaaagcatgttgtttcaacatatgtagcaatacatagcgtcgcggggtggagcagctcggtagctcgctgggctcataacccagaggtcgtaggttcgaatcctgcccccgctactaagattccaaaaccctcttcaacttttgttgaagagggttttggcgttctggggtctgaatctgaaagctagtctacggttcgtcggccgtatttccagtagccgaggaaagtgattcgtgaggaatcaactcggtagctgttgattagttctttgcgaatgaagcgcaccatgctagtttcaccggcgatccagaagtgtactgaaggatctgctgcattggctgaagcccattggaagacctttgctttgtaagcgtcgatgtcttcgaaagtgagcttggtggagctatcggcgatcaatacatcatcttctaggctgtctacgtggaggaaaaccgtagtaggtacttttgattgattgacgatatttgcgatcgcgggagctgatgcacaatcgccgatgagacagaggcgatcgatcgcagaagtcggatgataggtgattccgtagccggtttctcctgcgcgtacgtcagggccggtgatgattagttcatcgtcaacactgcagttctttgcccatctggatactggtcccgaagggttgtgaagatagatatcaatgtctacttcgcatagttcgggtcggaccgcagatggggtgtaggtgcgcaagatcggtcgttggtccgctggaaaagacttagcacgaggaagccacgttgtcggtgggggagtgggttcgtcgagaattccgaaatctgggatgttcccagccgggcttggaatgatcagtttgatgcgttggtccaaaccccactggccaaagaatcggagcttgtcaccagtgacggtgatccgcatgaagccgggactaagccgttgcttctgcgagatctgcacggggaaggcactgtattcccacttgagctgatcggggagagctgtggacattattgctgtgcgtcgaggaaggcatcgatgtcttccaagactttgctgccgccaagtggaccgacgccagatacccagtagctggtatcgacaagggtgagtgatgggaactgttcgcggttttctcggattacttcggggagctcattttcatcggtgacatcagttgcggtgacaaagacgtagtcggcggtggcgagcatgaagttctcaggagcgatgtcggcctggaggtcatccttccattcctgatcaggaatggtgagtcctgcgcactccaaagagctgccggcaaatgaggtcgggccgtataggctcatggtttgctcgtcgcggggacgaatcatgttgacggtcttaccttcgacatcatgctcggacttgatctcttcgcacttgtcattaaagccttggatgagatcctcggattcctgcttcttgcccaatgcatcgccgatgaagacgacattgtctttccacggatcaacatgggttgtcatgaacacggttggggcgatggattcgaggcggtcgtagatttcggcgtggcgggaatcggtgcccaggatcaggtcgggctcgagagcagcgatcgcttcgatatttggctcagaaacggtgccgacaggctcgattccatcgacgccgagatatgcaggaataccagtgacgttgttggcgacagctgcacccactggggtgattccgagggcgattgcggtgtctagctcaagtggctcgaggacaacgacgcgctgaggattttcgggaacttcggttgttccgtgagcgtctgtgaattcgcgagtcgcagagctggtggatgcttcctcttctgagctggaggaacaagcagtaagaggtagtgctgctgcgagaagcacgatcagtgcggaggagagttttctgcgagatgacatgggctgtgaatatcctgactttagattgaaaaagattaggcaaaccttacagcttcggtcaggtgtgtgtaaataggggaaaacttagacgtgggggtgggcgtcggcaagcaaaaaagaccggcacaaccgcaaaggttgcgccggcctgaaagccttaaatgcctagaacatgtagcggaatgaccacacagctgcggctgcgatgagcagcagccagacgatcgcgatgacccacttgtatttgtacagtgcgttgacgaacgtgctgtcggagccgctgaaagttttcacattccatgcagtgaccagcacgaacatgatgatcgatacggtccacacgcccatgcagtaagggcagagcgcgcggatgacggacatggattggtaggcgagccagtggcagaacatcatggcaaaagtgagtccggcctgggcgccgaaccagaaccaaccgcggaacccgccgcccgcgaggatgccggcgccgatgatggcgacagcggcgaaaccggcgatgccgatgagcggattcgggatgccgaacgcgttagcttggccggaacgcatgacatcgccacaagctaggactgcattgaaatcgcagctggtgatgtgaccgggatcctcgaggatggcaagtttttcggccatgatgatcaccgacaaaatgaggccgattattccgccgatcatgagcacccagccaagccaagttggggccttgggtggggcgttgtggatttcggtagacacggggagacctccgggtgggaaaacgtttgttgactgacgattaatcttaagtcttttggcttgatttcttgtgctgtgcgccgaagttcacaggctagctatacagaaagtgccaaattagacaggttttcgctacagaaagcgtaatgcccttcataaatttatgcaggggtgacagggttagctaagacctgcgcgtatgcaacgaaaatatgtgtcttaagtcgcaaaggtttggcttggttaactagctgtgttaactttcatctttaggtaacctaacctcactaaaactctgggaatactctggcagttttggtggattatttttatagactttcaaaggacgacatggtgaaaaaccgattcaagctagtttcaatcgcaactgttgctgccctggcgctcgttggctgctcttccaccgacagcacctcttccgagtcttcttccgctgcagagtcaaccgctgcagctagcaccctgactatcgaagacaaccacggcaccgaagggatctccctgccaatcgagggcgtcgctgcgaccgacaaccgcgcattcgaactgcttgatcgctggggtgtagagctcgttgcagctccacttcagctggttccatttaccgttacgggctacaccgaagagggcggcgtcgctaaccttggctcccaccgcgagccagacctggaagcacttgctgctgcacagccttccctgatcatcaacggccagcgcttcgctcagtactacgatgacatcattgccctgaaccctgacgcaaccgttgttgagctagacccacgcgatggcgagccacttgaccaggagcttatccgccaggctgaaaccctcggtgagatcttcggcgaagaagaagatgctgcaaagatcgttgctgatttcgagtccgcacttgagcgcgctaagaccgcatacgcagcaatctccgaccagaccgtcatggcagttaacgtttccggcggaaacattggctacatcgctccttccgttggacgcacctacggcccaatcttcgacctggttggactcaccccagcactcgaggttggcaacgcgtcctccgaccacgagggcgacgacattaacgtcgaagcaatcgcagctgcaaacccagacctgatcctggtcatggaccgcgatggtggcaccagcacccgcaacgaagctgattacgttccagcagagcagatcgtctccgacaatgaagcactggcaaacgtcaaggctgtcaccgacggatacgtttactacgcacctgcagatacctacaccaacgaaaacatcatcacctacaccgagatcctcaacggcatggcagatatgttcgagaaggcagctcagtaggggatcgatcccacactgacccctaagtaatgcgcaaagttttatgcgtaaaaatttcttaggttaggctctaatatgaaaggctgtcttgtaaagaacaaggcagcctttttacttgtcttaaataaatattttgaattgagaaccaagacctcgttttggccgcaagttctcgttagttaaaaactgtaggaaaccaggttccacacatgacacacaatcggtttaacagggaaggggatcggcactgatggcaacaccagcatcggctcccacttccgaaccacgtctcaaacgcaccagagccaagctttttgattggaagcttctcatcggcatcattttcgtcgccggcctcgtggtgctttccctcctcaccggccaatacgacattttcggtggcgatgatggccaactgatgttcgaggcagttcgcatcccgcgtaccgtttccctcattttgtccggtgcagcaatggcgatgtgtggcttagtcatgcagctgttgacccaaaacaaattcgtggaacccagcaccacaggaacaaccgaatgggcaggtcttggcctcctcttcgtgatttacttcgtgccagccgcgaccgttttggatcgcatgctcggtgccgtggtgttttccttcatcggaaccatggtgttcttcctctttctacgccgagtaacactgcgttcctcattgatcgtcccgattatcggcatcatgctcggtgccgtggtgtcatcgatctccagcttcttcgccttgcaattcgacatgctccagcaattgggaacatggtttgcgggttcctttaatacagtgttccgcggacagtacgaagtgctgtggatcgttgtcatcgtcgttattgcagtgttcttcttcgcagaccggctcaccgtagctggccttggcgaggaaatcgcgacaaacgtgggtctcaattacaaccgcatggtccttatcggaactggcctcatcgccatcgcaacaggtgtggtcaccgtcgtggttggtagcctgccattcctcggactcatcgtgcccaacgttgtgtccatgttccgtggcgatgacctgcgctcgaacctgccatgggtatgcctaaccggcatcgcgatcgtaaccatttgtgacttgatcagccgaaccatcatcgcgcctttcgaaattccagtttcagtaatcctgggcatcatcggcgcagtggtcttcgtgatcatgattgtgaggcaacgtggccgtggataaagatattgaaaaccgcacctcagacctttctcgatgggaaactatggaggaatcagcaacggtcgagggacgcaccgatgtcgaactagcatcagcgccgagcaaacgacgcacctcaggtgcattccaaacagcgcgcgccaagcgccgctactggatcatcatggccgcgctgctggtcaccgcgcttgccttcacctggggcctcatttggtacaagaacccgatgcccgttgggcatccggccttcgcgctgattgcagaacgacgcatggagtcggtctttgtcatgctgattgttgcggtttgccaaggctttgcgacggttgcgttccagaccgtcaccaacaaccgcattatcacgccgtcgatcatgggctttgaatctctctacacactgattcatacctccacagtgttcttcttcggcgcaactgcactgctggccaccagaaatctcgaaatgtttgtcggccagctggtgatcatggttcttttgaccttggtcctctacacctggctgctttccggaaaacgcggcgatatgcacgccatgctgcttgtcggcatcatcattggtggcggactcggatccatctccacctttatgcagcgcattctgaccccatcagaattcgatattctttccgcccgacttttcggatcagtaaacaacgcggaaaccgaatacttcccaattgctgttccactagtagtagtggcgtccgtcttgttgctgctaagctctcgacgcctcaacgttgtagggcttggcaaagatgccgcaaccaaccttggaattaatcaccgacgatcctccatttacacactggttctcgtctctgtattaatggcagtatccaccgcacttgtcggaccgatgacattcctcggattcttggtcgcgaccttggcatatcaattcgccgacacttacgaccaccgatacatccttccgatgtccgcactcatcggattcgtcgtactcagcggcgcttactttgtcatgaaccacgtgttccgcgcacaaggcgtcgtgtccatcattattgagatggtcggcggtaccgtcttcctcatcgtcatcctcagaaagggcagactgtgattacgttaactaatgtccgcaaggaatactccagcgacgttgccatcggccccgtcaaccttgagatcccagccggcggcatcaccgcgttggtcggcccaaacggtgcaggcaagtcaacactgctcaccatgatcggtcgactcctcggcatcgatgaaggcaacatcaccgtagcctcctacgatgtcacctcaaccgcatccaaagatctggccaagatcatctccatcctgcgccaggaaaaccactttgttaccaagctgaccgtgcgccagctcgtaggtttcggacgcttcccatatagcaagggccggctgacggaagaagacgagggaatcatctcccgctacatcgacttcttcaatctcaccgaactcgaagaccgctacctcgaccagctttccggcggccagcgccagcgcgcctatgtcgccatggtgctgtgccaagagacggactacgtgcttctcgacgaacccctcaacaatcttgatatcgcacactcggtggaaatgatgaaacacctcgagaatgctgcagcccaatttggccgcaccatcatcgtggttcttcacgacatcaacttcgccgcgcgctacgccgattacatcgtggccgtaaagcacggaatgatcgaaaaagagggaacacctgaacagatcatgaaaaacgagatcctttcagaaatcttcaatacagagatcgaagttattgaaggaccacacggcaagattgcttgctaccactaaatgaagagaaataagccgacatttgatgtcggctttttcttttttctcgggctatttgagcttgagtcgggcggaaagcgcttcaacctgcggatttgtagaaaatctgggagtaacgtacatttaaacgcacaccagcaacgtggccaagaggttacaagctggttaagacatgcagaatgattaaaaaagaaactttgacttttttaaatcgactctgtaaggtcaatcaagctgctaggggagcaagtacaaacattgtatcttgttttcagagtgtgcgtatgttgtttgagaactcaatagtgtgccatttattatttttgtcactaccacaaccacttaggttgtggtgggtcatgccgggtggtggatcgccaattttatccatcactgtaaacaataatcttattgttggcatgattttgtgggtctgcttgttccccgtcaagggactaggcccacgttgaagacacgatgatccttatgtgggttgtggtgtttttttagaatcattattttttgataatgccagtaacaccccattatctgatcgcactgtgtgtggttggtgggggtgttgttgtttttgtcaggtgttgggcttttcacggcctgaacaatctatttattgttttttgtggagagtttgatcctggctcaggacgaacgctggcggcgtgcttaacacatgcaagtcgaacgctgaaaccggagcttgctttggtggatgagtggcgaacgggtgagtaacacgtgggtgatctgccctacactttgggataagcctgggaaactgggtctaataccgaatattcacaccaccgtaggggtggtgtggaaagccttgtgcggtgtgggatgagcctgcggcctatcagcttgttggtggggtaatggcctaccaaggcgtcgacgggtagccggcctgagagggtgtacggccacattgggactgagacacggcccagactcctacgggaggcagcagtggggaatattgcacaatgggcgcaagcctgatgcagcgacgccgcgtgggggatgaaggccttcgggttgtaaactcctttcgctagggacgaagccttttaggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggtcttccacgacttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatggaccggatcggcgtagagatacgttttcccttgtggtcggttcacaggtggtgcatggttgtcgtcagctcgtgtcgtgagatgttgggttaagtcccgcaacgagcgcaacccttgtcttatgttgccagcacattgtggtgggtactcatgagagactgccggggttaactcggaggaaggtggggatgacgtcaaatcatcatgccccttatgtccagggcttcacacatgctacaatggtcggtacagcgagttgccacaccgtgaggtggagctaatctcttaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaccttttaggggggagctgtcgaaggtgggatcggcgattgggacgaagtcgtaacaaggtagccgtaccggaaggtgcggctggatcacctcctttctaaggagctttattaacccacatcagactgtgtctggttggtgggttgttggtgttggaacccgtatgtggttgccatcaacatatttttaatcgggtggagatgacccctcgggtgacaacaacacagcaaacagtgctgtgattaataggtggcatgctgttgggtgtctggaatgacatcgcaagcatcaccttttggtggtgtgtgtgggttgtttctaacatcgagcatcgtcaacacgggtagagaatgttgtgttctttggttgtggtgggggtggtgtgttgtgtgagaactgtatagtggacgcgagcatctttatttttttgttttttgttgtgtgataccgaacgcgcccgcactttgtgtgtgggttatagtattttgtttgttgttttgtagggcacacggtggatgccttggcatatcaagccgatgaaggacgtgagaggctgcgttatgcctcggggagttgccaactaagcgttgatccgaggatgtccgaatggggaaacccagccgcagtgatgtgtggttacctgccagtgaatgtatagctggtgtggaggtttacacggggaagtgaaacatctcagtacccgtaggagaagaaaacaattgtgattccgttagtagtggcgagcgaacgtggatgatggctaaaacttatgtgtgtgatacccggcaggggttgcatgtaggtggttgtggggcaatgacgttcatattctgccggatgtgggcatgtgctgcgtggttagtggaagtggtgtggaaacacctgccgtagaaggtgagagtcctgtacacgaagatcatggtggtgtgtgtggttgttgataccccgagtagcagcgggctcgtggaatctgctgtgaattagccgggaccacccggtaagcctgaatacttgatatgaccgatagcggattagtaccgtgagggaatggtgaaaagtaccccgggaggggagtgaaatagtacctgaaaccgtgtgctgtcaatccgtcagagcatcctttgtggtgtgatggcgtgccttttgaagaatgagcctgcgagtcagcggcatgtcgcgaggttaacccgtgtggggtagccgtagggaaaccgaatcctaacgagggtgttttagtggcatgtcttggacccgaagcggagtgatctacccatggccagtgtgaagcagctgtaagaggttgtggaggcgcgaacccacttaggttgaaaactgaggggatgagttgtgggtaggggtgaaaggccaatcaaactccgtgatagctggttctccccgaaatgcatttaggtgcagcgtcgtgtgtttcttgccggaggtagagctactggatggtttagcgggaccaacatcttagcgacatcagccaaactccgaatgccggtaagttagagcacggcagtgagactgcgggggataagcttcgtagtcgagagggaaacagcccagatcgccggctaaggcccctaagggtgtgctaagtggaaaaggaggtggggtcgcgaagacagccaggaggttggcttagaagcagccatccttgaaagagtgcgtaatagctcactggtcgagtgattccgcgccgacaatgtagtggggcttaagtacaccgccgaagccgcggcaatgatctttataggattgttgggtaggggagcgtcgtgcatgcgttgaagctttggggtgaccttgggtggagtgtgtgcgagtgagaatgcaggcatgagtaacgaatgatgcgtgagaaacgtatccgccggatgactaagggttcctgggtcaagttaatcttcccagggtgagtcggggcctaaggcgaggccgacaggcgtagtcgatggataacgggttgatattcccgtacccgagtatgagcgaccatggtgaatcagtgatactaaccacccataagcacccgcgaaaaggctttgcttttttgtggtgtgtggttgcgtgggacctgatctggtagtagctaagtgatggggtgacgcagggaggtagctcagccacttattggattgtggtgtaagcgtgtggcacgcagtgttggtaaatccgcactgtttttgtgtgaggcgtgatgcggagcccgtaaagggtgaagtgggtgatcctgtgctgtcgagaaaagcctctagcgatgttgatattcggcccgtaccctaaaccgacacaggtagtcaggtagagaatactaaggcgttcgggtgaactgtggttaaggaactcggcaaaatgcccccgtaacttcgggagaaggggggccacggcgtgtgaacaacttttcgttgggagcgtgttgtggtcgcagagaatagagggaagcgactgtttactaaaaacacaggtccgtgcgaagacgtttaagttgatgtatacggactgacgcctgcccggtgctggaaggttaagaggaccggttagccgtaaggcgaagctgagaatttaagccccagtaaacggcggtggtaactataaccatcctaaggtagcgaaattccttgtcgggtaagttccgacctgcacgaatggcgtaacgacttccctgctgtctcaaccacaggcccggtgaaattgcagtacgagtaaagatgctcgttacgcgcggcaggacgaaaagaccccgggaccttcactatagcttggtattggtgtttgattcggtttgtgtaggataggtgggagactgtgatcatatgacgctagttgtgtgtgagtcgttggtgaaataccactctgatcggattggatgtcttaaccttggcccatgatctgggttggggacagtgcctggtgggtagtttaactggggcggttgcctcctaaaatgtaacggaggcgcccaaaggtttcctcagcttggttggtaatcaggtggtgagtgtaagtgcacaagggagcttgactgtgacactgacaggtggagcagggacgaaagtcgggactagtgatccggcacctacttgtggttgtggtgtcgctcaacggataaaaggtaccccggggataacaggctgatcttccccaagagtccatatcgacgggatggtttggcacctcgatgtcggctcgtcgcatcctggggctggagtaggtcccaagggttgggctgttcgcccattaaagcggcacgcgagctgggtttagaacgtcgtgagacagttcggtctctatccgccgcgcgcgttgaaacttgaaggaaggctgtccctagtacgagaggaccgggacggacgtacctctggtgtgccagttgttccgccaggagcagggctggttggctacgtacgggagggataaccgctgaaagcatctaagcgggaagcctgtttcgagatgaggtttcttttgaggttccctagagattatggggttgataggccagatctggaagcactgtgaggtgtggaggtgactggtactaatttaccgataacaacaaaccattacggtttggtgtaacgcaacgtaacgaaaacagaacaatatgtgttcgcgtccattatgcagtgtctgacacagcacaaccaacctttggttggtgtggtgtgtggttgtgtcggtggtgatagtagcagggaaacgcccggtccctttccgaacccggaagctaagcctggttacgctgatggtactgcactcgggagggtgtgggagagtaggttaccgccgaccaaaaacttaaaatagtatggataagcccagaaacactgtgtgtttctgggtttattcgtgtttgagggggtgtggtggatacacatggttgtgtgttcaccgcaccctctctttttttgtgtttgtgggggtcttgggccccttgtgcacgcggcacgcacgctgggggcaagcgtcgacaagcacaaactttttgcttaattgaatcctttgcgcaccaatcaatgggggatcaaatatagtagctgcatgagtaatgacttcgtcgtttctaggcttagaccctttggtgaaacgatttttgcaaccatgacccagcgagctgttgaggcgggtgcaatcaatcttggtcagggctttcctgatgaggatggtcctcgtcggatgttagagatcgcgtcggagcagattctcgggggaaataatcagtattcggcggggcgtggggatgcttcgttgagggcagctgtggctcgtgatcatttggagaggtttgatctggagtacaaccctgattcggaggtgttgatcacggtgggggccactgaggcgattacggcgactgtgttgggtttggtggagcctggggatgaagtgatcgttttggaaccgtattacgatgcgtatgcggcggctattgcgttggcgggggcgacgcgggtggcggttcctttgcaggaggtggagaactcgtgggatgtggatgtcgataagttgcatgcggcggtgactaagaagacgcggatgattatcgttaattcgccgcataatccgacgggttcggtgttttctaagaaggcgttgaagcagttggcgggtgttgctcgtgcgtatgacttgttggtgttgtcagatgaggtgtatgagcatcttgtttttgatgatcagaagcatgtgagtgtcgcgaagctgcccggtatgtgggatcgcacggtgacggtgtcgtcggcggcgaaaacgttcaatgtgactggttggaagacggggtgggcgttggcaccggagccgttgttggaggcggtgttgaaggcgaagcagtttatgtcttatgtgggggctacaccttttcagccggctgtggcgcatgcgattgaacatgagcagaagtgggtgtcaaagatgtctaaggggcttgagctcaagcgggatattttgcgtactgcgttagataaggcggggctgaagactcatgacagtatgggcacgtatttcatcgttgcggatattggggatcgtgatggtgcggagttctgttttgagttgattgagaaggttggggtggcggcgattccggtgcaggcgtttgtggatcatccgaagaagtggtcgtcgaaggttcgttttgcgttttgcaaaaaagaagagacgctccgcgaagctgcggagcgtctcaaggggattaagaaactatagtttgaacaggttgttgggggtctttttaacgtcctccaacttgccgcggttcttttctagtttggcccagagttcgtgggggatagttttctcggcttcacggatgatgtctttgtccgtggtgccccaggtaattggcatggggctgatttcatcccagtggtcttggtctttgacggtgcgtcggccggtgattgcgacggatgggatacgttcgccgaggcgacgttcgtgtgctccgacgcgaacgatcgtgcgggtggccaatgcccactctggtttggcttcggggttcacattgcggttgacgagtgccaggaggaccacatcgcgggggtttacttctgcgatgatggcgggggctagttcgtagtcatcgtagagcgtttgtgcgttgcccatttggcgggggatcacaggaatcatgatgaagctcaacagggcgaggaagaccatgacgatggcgatcatccacatccacactgctccgttagaaaacaggtagacggctacggctccgccgccgaggatgagtccaaggcacagtgctgagatctggagtcgctttgcgtcgcggaggatttcgttgttcttcttggcgtaggattcgtccacgtcgaaggagaagttgtgcacgttatagctctttcttgggtagtgggaagaggatgtcgtcggcgtcgaggatgcggtatgcgtagccttgttcggcgaggaatcgctggcggtgggctgcgtattcggtgtcgagggtgtcgcggctgacgatggagtagaagtgggcttcgctgccatcgtgcttgggtcgcaggaggcggcctaagcgttgggcttcttcttgtcggctgccgaatgttccagagacctggatggctacggatgcttcgggcaggtcgatggagaagttcgccactttggagacaaccagtacggaaagcgagccggaacggaattgatcaaagagggcttcacgctttttgttgggcgttttgccgtcgatgactggtgcgttgaattctgcacctagttcttccaactgatcgaggtatgcgccgatgatcagcgtgggcttaccagcgtgctcttcgaggagtttgcgcaccacggccaccttagtgtgggcagtggcggctagacggtaacgatctgccgactcggcagtcgcgtacaccatgcgctcagcatcggtcatggtggatcggatttctacgcagtcggcggtggcgatgaacccttgggactcgaggtctttccatggtgcgtcgtaacgcttggggccgatcaggctgaagacatcgccttctcgtccgtcttcgcgcacgagggtggcagtcagtccgaggcgtcgcctggattgcaggtcggaggtcatgcggaaaacgggggcgggaagaagatggacttcgtcgtaaataattaagccccagtcgcgggaatcaaaaagctcgagagctttgtattcgcctttggtacgcctggtgactacttggtaggtggcgatggtgacgggtcggatttctttgcgttcgccggagtactcaccgatttcgtcttcggtgagtgtggtgcggcgaagaagttcgtctttccactgtcggccggccacggtgttggtgacaaggatcaaggtggttgcctgtgcgcgagccatggaggctgcaccgaccatggttttacccgcgccacaaggcagcacgactacgccggaaccgccttcccagaaggaatcggctgccatttgctgataatcgcgcagcgaccagtcttcaaattcagtggagagaccaatggggtgggattcaccgtccacatatcccgcgagatcttccgctggccaaccgaccttgagcagttcctgcttgaggcgcccgcgttctgacggatggaccacgatggtttcaggatccacttgtgcgcccagcatgggtttgatctttttgtgccgggagatttccaccaggatcgcaggttcgccagattcaaggatcagcccgtgtgcggggtgacggtgcaggcgcacacgtccgtagcgggacatcgtctctgcgatgtcgatcaggagcgcttgcggaacggggaagcgtgaaaaacgctccagcatgtccacgacttgttcggcgtcgtggcctgcggcgcgcgcgttccacaacgccagaggggtgatgcggtaggtgtgaatatgctcgggtgcacgctcgagctctgcaaaaggtgctagagctatgcgtgcttcgcctgcttgggggtgatctatttctagcaggactgtcttatcggattggacgattaaaggtccatcgccaaaagccacgaaatgcttctcctaacgaggtttaaacgtccattatgtcacttctaggctagttatccactattacttctgtgatcctgtgcaacatgaaacgatgcaccgcacctgtggcttcatccacagcgtccacctgcccggcgttgacggttaaaggcttgacgacgcggtgcacggccacgccttgcttatcgacgaaccccaacgtcaccgtgcgctgccctcgcactgcagcctgcagcaccgaaagagttggctgtgtggaaacagttccttgagatgctgaattttcccgtcggattgctttgactgctgcctgtacccggctttcatccagtgccggaacaactggtggtggggaagctgcgggcacacgtgcaggggatggcgagatattcagacttgcgccttcgccgtcttctgccacaggttggaacccggcagcacgcagcacagtgatcacctgaagcaggggtgcttgagcaatcgcaacggtgggagcgatctgccgaagcgccacatcggcgcccgcctccactgcggaatgcagcaaagcgggatcgtcgctacggatataggacagtgcagggccgcctcggagggtgccgtgctttctggcgatatcgctgagcaaatagcccacagattggggcagatctgtcatggaatgttctttgagaaactccaagatttccggggtggtgagcccaagatccagagcatgcctgatggatttctcgctgagtcgatacaccgaggccaaaccaggtgattccaacgatgcgatcgaatccatggttttttgcatcgcaggggttagtggtcctggaaccatgatggtgaaatcgccttgcacgatgaaattctccaccggcgcaggagccttgattacctccgtagggttttcgccatcaattaaggcctgacccgctgcggtcacgccttgagaatatgctccgatccactgggcttcctgtaccagctgtgtgatggtgtcaggattcatccgactcgccgcaaggggataatggaatgctaaatccgcgtgcagattgtccactaaaaccctagataaagaggacaggatcttcgcacgagcatcaggaagcgaatcaatgatgcttgttttactgagaacatggatcggcttgtccttatcatcagcccgacccaccaaccacggcgcgtaagtttgcttccaccaaccagacatcaacgtgcccaattggtgcgccagatcatattccatccattcgtcagccagcggggtgggagcgacgtaatcgccgccatcatcatccatgggcaatggatcgggcacgcctttacggattagaccgctggccatacccaaactcagtagacgtgccagctcggtctcatcaaggtctaattccttgctcaggcgagtcaccacgcgcacaccgagggctccgactttcagcgtgggggcgggaacgtggctgagggcgtcgataagcaatcgcatgtgccgcaccacctcaaggccggctgcaatgccgccatcattcgaacctggcgccgccgtgcgcggaattgggcgcacctgagcgggcagctgctcgcggccctcaatcacacgccgcaccatcgccggcaggcgcacggtctgctcatccacgcgcgccaacaaccccgacgccagcaactgcggaatcggccgcgacggatccgcatcaggcgccgcatcgcgcgtcagaccgaagccacccgaggccgcaagcgtgtgcaaaagtttgcggtgcctatcagaaagcttatcgacgctttccctcacctgttcctcactctgcccgcgatcacttacctccggaagcaaccgccaatgaacaggcaacgcaggcatcgtctcctgagcaatcatcaactggtcatcgccataaaccaacgcgaaatttttcagcgtggcaagagccgcaccaatcgtgtcttgcgctggaagatcctctgccaacgccacatgcaaatattccaccacttcgggggcagtaaccgggtggagttcaccaccaaggttggccacggcctccaacacaccaagttccaacgcattgagtttcaacaccgcgcgaatcgcagacgccctcagctgtaaacgcgcagcaagagaggccaaattaggtggtaaagggagaaccgtatcgggtcgatttctaaggattgtggagagctgatcatcactttgagtatccaaccaccccttgagggtggggatgggggagtcttttttcatgatgttgttaagtttaagccttgttgaggtgacttttgttcccagagtttgaaagaatgtatgacatggcaaacgtagagaagaagcacttcgtcgatccggcatggccggagcacaatccagctgacggacacgtcgttactgaactcatctccaaggtcgcaggcgcgtccagcccatggggcgatgacaaggaattcccagtttctgcagaagagaccggatacgttcacccgtacacccggatcaaccgctaagaaacttaaaaaagaggcaacccgtttcggcggtgttgcctcttttttcatgcggtttttctactgggcgtactttcggcaccaaggtttcggcaaaatggtggccaaaatcaggaaatcttggtgcccaattcacaaaaggatgactggcgcgtcgtgaaatggcatgcaaaaagggagggaacccgtttaaggttccctcccttttaaaaagtgcagctagatttagccgacgaaagcgttgtagtaagactcaacctcagctggaacggtgatgccgtactgagcgagggtgccggtgacagcgccgtaggtggacttgatggtgttcaagtcggtggagccaactgcgatgttggctgcaggagcgttgtactcagcaacagctggtgcagctgcagctggctctggggtggaggtggtagcggagaggtcacgctgggttggagcggagttcagtccaagggaagcggagcaagcaggccatgcgccccagccctgaccagccaaggtgcgctctgcaacagcgatctgctgctcacgggttgcctggtatgcgtaggtagcgaactcctggccgccgtaagcagcccaggtgctagcggagaactgcagaccaccgtggtagccgttaccggtgttgattgcccagttaccaccggactcgcactgtgcgaggcgatcccagtcggaatcaggtgcagcagatgcagaaggagccatgatggttgcagcagcaccgaaagcgatggtggaagctgcgagcttggtgaacgcggagctagtcttagtggagtgacgtcccatgaaaagttttcctctcatttgtcgccgtcgaggttagctgtcgggttagagcggaggagttgctctgccagtggatgtctggcttcaccccaaggagttggcctccatgccttcttttgtgaaaagatggtgggtggtttccccgtccctgtctgcaatatggcccacatgaatgcgggagtttgtggtttaaagttctgttgcaccaaggaggttgttcaacttccgaccccagacagggtttggcgatgagccggacttgcagatgaactgttgcggtgcctgggatacacggtaacccgaaggtcacgattgtgtcacgttatttacgaaatctatatcaatctgactttggtgcgaccttgaagtcgcaggtcatcccgcctgaatcatcgggtgtgatttatgttacatatttggaatatttcgggtagcgatgtaactttccgggaaatttttaccgcgatgcttgcggtgtataataatttcttctggtcaaaaatagttgatcaatttgaatcagcatatgaattaggaatgaaagtggtgaggacaagtgcctgtcggaacagtgaagtggtacgacgcggagcgtggtttcggctttgtctccaatccaggtggtgaagattgcttcgtaggtaagcaagtacttcccaagggagtcaccgaattgcacaagggacagcgaatcgattttgacttcgccgcaggccgtaagggccctcaagcacttcgaataaagattcttgaaactccacgcaggcgtccacagcacaaatacaagccagaagagctcaacggaatgatctctgacctcatcacgcttctagaaagtggagtgcaaccaggccttgccaaagggcaatacccggagcacaaagctggagcgcaggtagcagaaattcttcgcgttgttgcgaaggagcttgagtcttaaaacaataaggagaggatccgaaaacggatcctctccttattgtttgtgagtgagttactcgttcatcgtggatagcgaccacgtgacggtgtaagggctttcctcaccattttcatcctcaccgatcatcacagcggacacttccactacgaccagacgtgggcgctccgcaccctcttcggttggatccacagaaccaggaacggttgcctcggtggcgtcgtaactggtgtggtagaactcgtcatttgcagccggatcatcataaatggtcaacaagtaccagtcatgatcatgaattgcctctggaatcgtcaggtgcaactcttcatcagcaccaacttccagcgttggcacctcgttctcttcgcattcaacacctggttcacacatgctgaatgggaatacctcgatttcaccagcgggagaagatgctgagatagagatctcttgggggagtggctctgggcgattgttccaccattgctggaacaccacagacaaaatcaccaccaataacacagcaacgataaggctgagaatctgaatgaggtttttacgcttggtcttccggcttgccatgagtcttgattctagtcagcagggacgaatctaacctcatagaggtcaggccaacgcttaccagtgatataaaaacgatcggaatccggaatatgtgcaatgccgttgagcacattgtttgtatctggtgtggcgttgttaggaatatttgaggcatcgatcactgcggtgacttcgccggagttcggatcgattcgcatgatgtctgtatcgaggaaaatattggcatatacctcgccatcaacgcattcgagctcattgaggttcccaaccggagagccgtctagtgtcacatctacagtgctgttctctgcaaaggtttccggatccctaaaggtgagggtggagcttccatcagaggtgatgagggcatcgtcagttgagcaaattccccacccctggccattatatgaaacgcgatctaactcctcgagagtatctgcatcacgcttgaaagcgacaccttcattccatgtcagctgccagatggcatcaccagacttggtgatgccttcaccgaagaattctggatcaagcgattgggaaacagattcctggccatcaacggagctgcgatagattcgggaaccaccgtattggccagttcccacaatcagctcgtcgccatctaattccaacccctgagtaaacgaggtggaatcaaaagagtgggtggagataatttctggaaccagatgctcaacgacagcctctgaatctgttggaggagtggaacacgaagccaaagggaggctggagaggatcgctatggatgcaagctttttcacagccccgagaataacagtcgagcgacctacacttgctgtgcagtgctccataggtagtcattgacttcagaaaacgtcggcacgaaagctgccacaggtcgcgtttctgagactgggaatttggaaccgtattcgagccatgcagcgacgcgacggatgccggacaaagaatccaccagccacacttccgaagagcgcaaatcattgatgttgaagccttgctctcgaggctttgcattacagccttgttcctgcaggtaggcaatgaccgttgattccagaacagacggcagcgacctggggtgcgtggaatgaaacacggtgtcgcccttaatcgccaagagagaggcattgatagccatgatcacctggccggactcgtcgacaagcaatccatcatcggcgccctggcggcggctgtttgcggtggccgtgttctgccacgcgatatcgtggcctttaatctttggatgtaggcgctcatcgcggtggccgtgggtatcaagggtgaccagtgaatttaacttgcggggcgggcgcagctcgacgttatagtggttattttcaatcgtgacagctgcctgaacactgcccggagcttcacgcaattgagtgatgatgcgatcatggaactgtgaagcagtaggggctgccgcctcgaggcgatcgatgtggccctgaagattgcggatgtgtccgtcaaccatgagaaaacttgtggtcaccacgacgtgtagttagaccttccggaatcgaaaaagctggtgaaagtgcattttatttgagattatcaccctactagccaaactgcggatttagcgtgtccaccccttgagttacagtgtgggcgtaggtgaaattggtttgggccactggggtgggtttttggtgggttcatcacttttaggcggtggacttgccccatctggtaggcagatggaaaaattctgttgcgctaaaggtttcagctaaaagaagaatccttgctagtggaatcagctgagttttccacgagttttccagctttctcacaacttgaatagaaattgaggtatccggcaatgacgtcagggaaatcaacgagtactaggggagccctagaccggtatttcaaaatctcggagcgaggatcaagcattggcacggaaatccgtgcaggtgtggtcacattcttcgcgatggcctacatcatcatcctcaaccccttgatccttggcaccacccctgacgtagagggcaacaccctaggcatcgcacaggttgcagcggcaacagcgcttgccgctggtgtcatgaccatcgcgtttggtttgattgcgcgttatccattcggcattgctgctggcctgggaattaacaccatggtcgccgtgacactggtttcaggtgagggcctgacctggccggaagcaatgggacttgtggtccttgacggtgtggtcattgttattttggctgtgtccggcttccgtgttgctgtgttccgtgcgatcccagcatccatgaaggcggccatcagcgtgggtatcggcctgttcatcgccatgatcggcctcgtggatgcaggctttgttcgccgtattccagatgctgccggtactactgtgccagtgactttgggcattgatggttccattgcgtcttggccaacgttcgtgttcgttgtcggtgttcttctctgtggcatccttgttgtccgtcgagttcgcggtggactgtttatcggcattttgggaaccaccattttggcgatcatcgcagaagcaatctttgattccggtgcgtcctttgaaaatggtgaagcaaacgcagaaggctggtcactcgccgttcctggtctcccagactccttcggtggcatcccggatctttccatcgtcggcgcagttgatttgatcggtgcgttcagccgcatcggtgtggtcgccgcgaccttgctgatctttaccctggtccttgcaaacttcttcgacgccatgggcaccatgaccgctcttggtaagcagggcaacttggttgatgatgaaggcaaccttccagacattaagaaggcactggttgtggaaggcgcaggtgccattgtcggtggtgctttctctgcatcctccaacaccgtgttcgctgactcttctgcaggtgttgcagacggcgcacgaaccggccttgccaacgtggtcaccggctccttgttcttggctgccatgttcttgaccccactgtatgaaatcgtccccatcgaagcagcagcaccagtgcttgtagttgttggcgcgatgatgatggggcaggttaccgagattgatttctccaagttctacatcgcattcccagcgttcttgaccattgtgatcatgcctttcacctactccattgcaaacggcattggcgttggattcatcatgtacgccatcatggctgcagcggcaggcaaagcaaagcaagtgcactggctgatgtggctggtcgctggactcttcgtcgtgttcttcgcgattgatcccatcatggaagctgtcggctaatgacaacgcgcacggtaatttctgatcccgcagatcctcgtctggatgatgtccgcgatctcaaccattccgattcccggccagacctacccggtggcaaaggccttgttgttgccgaaggtccgttggtggttggtcggcttctggaatcgcgttacccagtgcgtgcgatcgtcgggtttaaaaacaagctggattctttcctcgacagcatcgatgcatcccttgttgaaggcatcccagtgtatgaggtatcccgcgagctcctcgcagaggtcgcaggttttgatatgcaccgcggacttctggcgacagccgatcgcaccgaggaagcaagtgttgcgcaggttctagaaaacgcccgcaccgtggtggtgctggaaggcgtaggcgatcacgaaaacatcggatccatgttccgcaacgcagcaggcatgggcgttgacgccatcttgttcggcaacggttgtgccgatcctttgtatcgacgtgtcgttcgagtctcaatgggccacgtgctccgcctgccgttcgcacacttggaaggcacctacaccacgtggcagcgcagcttagagcagctcaaagaagccggattccacctcgtttcactcaccccagatccagaggcggaacacctcgaagatgcgctcgcaggcaaagacaaagtggctctactcgtgggcgctgaaggcccaggcctgaccgagcatgcgatgcgcgccaccgatgtccgcgcccgcatcccgatggcgccgggtaccgatagcttgaacctggctacctcggcggcgattgcgttttatgaacgggatcgctcacagcgttaagtaacagcgctaagtagtagcgctagcggtcagtgtggcggagtctttccgccatgtttgacccgaattcgcggctggctcgccacagagatttaccaaatttctgtgctgagctggccgcttttttcgcgtttgaggtaatgcgcttggacaccactcgatcgggtgcctcgtattcttcgtagtcgtcgtagaaggcggattcgcgcagtcctagcttttcgacggcggaccttgtcacttcctcgctgttaattatgcggggtgcagcgatgcgcggctcggggcgaccatcggtggcataggcaacgacgttgatgtcaggggaggtggtggcgtcgaatccgagccatgcacgttgtgcttcgtggactagttcgatggggttgaagggcaacgacagcgcagttttccgggtgccttttttgcctgcccagtagggggtttcaaagccgccggggatgccgttgtcttcgaagacgcgctcttcataggcgatgaaggatcgtttgatctcaccgttgtagatgtgtgcgaagccaccaagggtggtttcttcattgacggcgaaaatgtagacatctgttgccgggacgctgcgcagtaaccgaggattcagcttggataaagaggtgacatcttccaacacggtttgaatgatggtgatgccgggaaaaccagcgatgtagaactcgttggcactagcaggaacggatctgttgagggcgaactgcccgatgggggtaattggccacgttgggttgagctgtgccaacagttttcggccatatccacgatccgcccgaggttccgagcggatgatggattggggatcggatgcgctaacaaaccagagggtgacgatcgccgcgttttctcccaattgacttggcatcagcacatcctatttcttcgggcgctttgtgtttgcgcgaactcctaaaagaacatcttcccagtgtggggttactgcttttcgacgcctgttgcgtgggccttccgcatcgacttcaggttcgttgtcgttggtgatttcagcaacggcatcggattctgagtctggtgcgtcgtcagggcttggtacggtgtcgaaaacatcggtttcgtcgtcgtactgttcctgggtggagtttacggacgtcaaggtacgtaccggctgaatgaattcaggatcgatcaaatcggctgcgactggggtccgcggatcagcggtgggattgctggtgttgtgcaggtttaacgtccactccgcgtagttgtcgctgagtcctgctttccaatcaactcgcacgatccactggttggtggcgtctttgtaggcgtcccagcgtgctgtggtgagatcgtggccgcgagtggcaaacgccgttgcaagaatttcccagagagtcagttttgcaggaccattttccctgatggggtgtgattgcttagccaagtcggcaatgcgggcacgttccagcaaaacggggtgggcatagggctcaacgcgggcttcggtgacgccgatttcttcggctaattcttcgatggtggcgcctgagcgaacccgaatctgaatttcgcggggtgacatcgtcaggggagcgctgatacgagggtcaatttctttttcctcacggggctcttctaccgcagcgaccggctctagaacaggaggtgggacctctttgtgttcttcgggttctggggcgctcttaatctcgctatgacctgcaagaatggcgtggagttcatctgttacagcaatgaaaaattcctcagcgccgtcctcttcggaggtcttgaaaaccaaggatgattcggtggaatcaccgctgatcaggaatatttcccgcatgttgactccttctagctgggttaagtgatcacccaagcttaactaaaaaacaccccgtactggtgtaactgtacggggtgtttttcaaagtgggggtattacttccttgcaaaaccgccatcgaggatgaagtcgattgctccggtgagcttttccacatcggtggaatcgatcgctgggaacataccgatgcgcagctggttgcgtcccagcttgcggtaaggctcggtgtccaggatgccgtttgcgcgcagtatcttagcgatcactgctgcgtcgatggagtcatcgaagtcgatggtgccgacaacgagggagcgcttagctgcatctgccacgtatggggatgcctcctcgcgagcctcagcccagttgtacagggcggaggagcttgctgtggtgcgagcaaccattccatccaggccgccgttggagttcatccacttgacctggttgtccagcatcagcaaggtagcaacagctggggtgttgtaggtctggttcttcagggagttatccactgcggtctgcaggttgaggaactcagggatgaagcgatcggaagcgttgatcttctcgatgcgctcgagagctgctgggctcatcgctgcaagccacaggccaccgtcggatgcgaagcacttctgtggggagaagtagtaaacatcggagttcttgatgtctactggcagtccaccagcgccggaggttgcgtcaatggcaaccagggagccttcagagccttcggggcgaagaactggaaccatggcgccagtggaggtttcgttgtgtgcccatgcaataacatcggcgccttcgaatgcctgtggggccggagagtcaccggtttctgcggtgacgatctctggctcgtcgagccaaggagcaagcttagaagcctttgcgaacttggaggagaactcaccgaaagaaaggtgaccggacttcttttcaatgagtccgaaggttgctgcatcccagaatgcggtcgcaccacctagggaaaggatgatctcgtagccttctggaagggagaagaggtcggagagtccctcgcggattgaacccacgacgttttttactgccggctgacggtgtgaggtaccgatgacggatgcggatccgtcgacaatagcctgaatctgttctggtcgaaccttggaaggtccgcagccgaaacggccgtcgccagggatgaactcagagggcagggtggggaagtcggtcatgtcttcgggcaactttctgcgcttggaagtaaaagggccagggatcgttaacgatctgacccaacaactataaccctgaagctgtcagttcctagcaccctagattcttcacgcagtctcccaaacgatgaaaaacgcccaaaactggcgacaccgaactattgaaaacgcggggattagttgaccagccaccaatttgggggtagctcaaagttttgcaaagttttcaatttctaggttgttaatatcccctgaggttgcgttatagggtggcgaattgcatggggaaagctactcggcacccatccttgtcgcgtgcatcacaaactttgctaaactgtgcaccagtccacttattgtgggatttttaatgccttaaaggccagcattttcaccctctagcggggttgaatgctggccttgagggtgcagaactaaatagcagcacatcggcacaattgatctgagttctattggcgtgaccgtggctactgattacggtggctgtgggtggtcgggaatgatgtaaccaacgtgattgtgggggaattggctctcacttcggatatggctaaaccgcatttatcggtatagcgtgttaaccggaccagattgggaaagaaatgtgtcgagtaacaaaaactgacatgcgcttggcgcatcccagttggtaagaataaacgggactacttccgtaatccggaagagtttttttccgaacaaatatgtttgaaagggatatcgtggctactgataacaacaaggctgtcctgcactaccccggtggcgagttcgaaatggacatcatcgaggcttctgagggtaacaacggtgttgtcctgggcaagatgctgtctgagactggactgatcacttttgacccaggttatgtgagcactggctccaccgagtcgaagatcacctacatcgatggcgatgcgggaatcctgcgttaccgcggctatgacatcgctgatctggctgagaatgccaccttcaacgaggtttcttacctacttatcaacggtgagctaccaaccccagatgagcttcacaagtttaacgacgagattcgccaccacacccttctggacgaggacttcaagtcccagttcaacgtgttcccacgcgacgctcacccaatggcaaccttggcttcctcggttaacattttgtctacctactaccaggaccagctgaacccactcgatgaggcacagcttgataaggcaaccgttcgcctcatggcaaaggttccaatgctggctgcgtacgcacaccgcgcacgcaagggtgctccttacatgtacccagacaactccctcaatgcgcgtgagaacttcctgcgcatgatgttcggttacccaaccgagccatacgagatcgacccaatcatggtcaaggctctggacaagctgctcatcctgcacgctgaccacgagcagaactgctccacctccaccgttcgtatgatcggttccgcacaggccaacatgtttgtctccatcgctggtggcatcaacgctctgtccggcccactgcacggtggcgcaaaccaggctgttctggagatgctcgaagacatcaagagcaaccacggtggcgacgcaaccgagttcatgaacaaggtcaagaacaaggaagacggcgtccgcctcatgggcttcggacaccgcgtttacaagaactacgatccacgtgcagcaatcgtcaaggagaccgcacacgagatcctcgagcacctcggtggcgacgatcttctggatctggcaatcaagctggaagaaattgcactggctgatgattacttcatctcccgcaagctctacccgaacgtagacttctacaccggcctgatctaccgcgcaatgggcttcccaactgacttcttcaccgtattgttcgcaatcggtcgtctgccaggatggatcgctcactaccgcgagcagctcggtgcagcaggcaacaagatcaaccgcccacgccaggtctacaccggcaacgaatcccgcaagttggttcctcgcgaggagcgctaaatttagcggatgattctcgttcaacttcggccgaagccacttcgtctgtcataatgacagggatggtttcggccgtttttgcatgaaaccaaaaaatacgattttcaaggagcatgtacagcacatggaaaagccacagattgagctaccggtcggtccagcaccggaagatctcgtaatctctgacatcatcgttggcgaaggagcagaagcccgcccaggtggagaagttgaggtccactatgtgggcgttgactttgaaaccggcgaggagtttgactcttcctgggatcgtggacagaccagccagttcccactcaacggcctcattgcaggttggcaagagggaattccaggcatgaaggtcggcggacgtcgtcagctgaccattccgccagaggctgcttacggccctgagggttccggccacccactgtctggccgtaccctggtgttcatcatcgatttgatcagcgcataattttctttactgcgctaaacgctcaaatcgtgtgaagcgactgtcgcgtcccgccctctccggattgttatccaattcggagagggcgttgctgattgtgccgagaatttcttcaacaaagtgctcggtttcggcgacgatcccgtcgataagcccttggcttaaaagtgcgtgcgcctgcacgccttgtcgctctatgatttccgcggcgtggttggtgtcgcggaagaggatggccgaggcgccctctggtggcaatgcggacagccacgcgttttcggccgcgtagaccagatcggcgggcagcatggccagcgcgccaccgccaacgccctgaccaataatgaccgaaacggtggggaggggagcgtcgataagcttggacaaggtgcgcgcaatcgagcttgcgatgccgagctcctcagccgcctgcgacaattcggcgccggaggtgtcgatgatggacacgatcggcaggtttagctcgcgcgccagcgaaatgccacgacgcgcaaaacgcagctcctgcggcccaagcgtgaagcggcgatcctgcccaatcagcaccacgggccggcccccgatgcgcgccagggcaacgcgcacagccgggctcaatgcgccagcacgcgcaccagaaagcttgacgacgtctgcccccaacgtttccataatctccccgattccaggcctctgcgggtcacgagaacgcgcaatcgcctccatcaccggaagtgccacgccaggagttgttggagaaaaacgatccgttgcctctaccggctgaataaccttgagggtttttgccaccgctgcacgcaattggagtggcgacacaattccatcaatcacaccagttttcaccaaattctccgcctgctgcacaccgtctggaagcgcatgcccagtggttaactccaccacgcgaggacccaggaaacctatctgcgcgccgggttccgcaaaagtgagatgcccagatgaaccccacgaggccatggcgccacccatcgtgggattgcgcaaatacaccaggaacggcaaatgcgcctcgcggtgacgctgcacagccgcggttatggacaccatcatgacaaaagctcgattgtcttcctgcatgcgcgcaccaccggaagcaggggagaccagcagtgggagtttcagctctgtggcgcggtgaatcgccttcatgatgcgcaccgacgcgaccgtgcccaaagaaccgccgaggaaggaaaaatcggacaaaataacggctaccggaatgccctccacggtgccttctccagtaattaccgattcatcgcatttggccttgcttcgagcccgctccaaggtctctgcatagccttgattgaggttgtcatattggggagtttcattccaagaaatgaagctgtcagggtccaaaaccgagtctatgagcgtcaatgctgaagtgtgttccatgccccacaccatagtcggaaaacgcttctccacggccgaaaaatggctttgttaattaattcgaatgtctctgcatacctatttagaggcggaagatctaagcccaatttaggctatcgattgcgtaaaaaatgacggattatgcgtttcatctcacaaaactacttttgcctagacgtcccgaacatagcctaaaaccggacagaatggtgacgtgtgaagcccgttaactattgcactgttgtgtttgcaatctttgcaaaaggggtatttcggggtaaagagggggtagatcgggaacttttataaatgcaggtaaaacactacttttaagtttaagttaagatattggggggagtgagttttccaaatcgctatcgcattgcaatgtgagttaggtaacttcacattcacacgtttagctgtgatcgacaacatacttcgtggtcgtcggccagatgtggtgagaaacatataagttgctttattttaaagccggcattgcttagagagtggccgatcaccgactcccgctcgagggatatgaaagcgagataagtttccagtgaatgcagaacaaatcacccaggggcgtcgccagccgacggctcaagagtttcgggacatgcaggcgagcccagaatttggagagctccgcagcaagttccgttcctttgctttcccaatgaccgttgccttcttcttgtggtacgtcgtctacgttctggttgcatcctttgcatcagagtggatggcaaccccagttttcggcgcaatcaacattggcctaatcttcggcttccttcagttcgtaaccacattcgtcattacttacatctatgtcatgtttgcgaacaagaacttggagcctcgtcaggctgctattcgccagaagatggaaggttaatcagatatgaattccactattctccttgcacaagacgctgtttctgagggcgtcggtaatccgattcttaacatcagtgtcttcgtcgtcttcattattgtgacgatgaccgtggtgcttcgcgtgggcaagagcaccagcgaatccaccgacttctacaccggtggtgcttccttctccggaacccagaacggtctggctatcgcaggtgactacctgtctgcagcgtccttcctcggaatcgttggtgcaatttcactcaacggttacgacggattcctttactccatcggcttcttcgtcgcatggcttgttgcactgctgctcgtggcagagccacttcgtaacgtgggccgcttcaccatggctgacgtgctgtccttccgactgcgtcagaaaccagtccgcgtcgctgcggcctgcggtaccctcgcggttaccctcttttacttgatcgctcagatggctggtgcaggttcgcttgtgtccgttctgctggacatccacgagttcaagtggcaggcagttgttgtcggtatcgttggcattgtcatgatcgcctacgttcttcttggcggtatgaagggcaccacatacgttcagatgattaaggcagttctgctggtcggtggcgttgccattatgaccgttctgaccttcgtcaaggtgtctggtggcctgaccacccttttaaatgacgctgttgagaagcacgccgcttcagattacgctgccaccaaggggtacgatccaacccagatcctggagcctggtctgcagtacggtgcaactctgaccactcagctggacttcatttccttggctctcgctctgtgtcttggaaccgctggtctgccacacgttctgatgcgcttctacaccgttcctaccgccaaggaagcacgtaagtctgtgacctgggctatcgtcctcattggtgcgttctacctgatgaccctggtccttggttacggcgctgcggcactggtcggtccagaccgcgtcattgccgcaccaggtgctgctaatgctgctgctcctctgctggccttcgagcttggtggttccatcttcatggcgctgatttccgcagttgcgttcgctaccgttctcgccgtggtcgcaggtcttgcaattaccgcatccgctgctgttggtcacgacatctacaacgctgttatccgcaacggtcagtccaccgaagcggagcaggtccgagtatcccgcatcaccgttgtcgtcattggcctgatttccattgtcctgggaattcttgcaatgacccagaacgttgcgttcctcgtggccctggccttcgcagttgcagcatccgctaacctgccaaccatcctgtactccctgtactggaagaagttcaacaccaccggcgctgtggccgctatctacaccggtctcatctccgcgctgctgctgatcttcctgtccccagcagtctccggtaatgacagcgcaatggttccaggtgcagactgggcaatcttcccactgaagaacccaggcctcgtctccatcccactggcattcatcgctggttggatcggcactttggttggcaagccagacaacatggatgatcttgctgccgaaatggaagttcgttccctcaccggtgtcggtgttgaaaaggctgttgatcactaaatctagtttctgaagttatttaaaccgcccactctccagtcggaggatgggcggttttcgcatgcagtactattagtggacgtgtcaagaacttctaaggttcacccgggatggcgggtgtctactgtccttttagcaggagtagttattattggcggaatttttactctccctcagaaggaggaagtaaaggtttccgaattgcagccacaggccagcgctgcatccatcccgtcttcatcttccacagctgggaaagcagtggaagaaagccctctaacgcagtttgtggaaaactcgacaggctcccaaattacgtacatgagcctgaaagacgatttccatactggcacgtctacggaacgttttgcgcgcccagcgttaagtttgtctaagctctacatcgctgaatatgtgctcgagcacggcacgaataatgagaagtctttggcgatggaaatgatcaaagattcctccgacgtatccgccgaaatcttgtatgaggcgtacccagaatcaattgaggagattgcggatcaatacggattgctctccacaaggggagacgcgcactggggatactcggtgacatccacttacgatttggtgaaatttgtcagcgctctcattatcgatgatccagattcaccgatccttgaagcgatgcgtaatgccagcgcagtcgcggctgacggttatccgcaagactgggggacagcggtgcttgatgaggcagaaggatccaaatggggatggtctgatgatctcatgctgcactcctctgtgacctttggcgaagactatgttgtggcagctgctgtgactggatcaaaagaagacctcacccaattggtggaaaaccaattgggtgaggttgtgagtcagcacggctagtttagctagatagggtgccaagaatcttgattacttggttgatggtgtcagcatcaattccagtacctgttcccgtgttggagtttccaggaatggtggggatggcatcgtcaaccgcgttgcctggggtccactgaccccagtcgtctgcatagacattgttcatgtcgatgccgactccgtcgagggtgtccttatcaatgcggatctggtggatggtggtgcgtgggtggatctttccttctgatccccagttgtgcatccagaagaattctccaaggccgtcggcgatagcccaattaatgacgttgtagttgccgtagacacctaactggtagccggcagcggacagcgcaacattgaatgcctggaggtaggggcgaatctgattggtgtattcagaccagcttgggttgtcgtcgatcgccacgtagatggggcgatttttagggccaccagctgccacgtgaagcgcaattgcctgtggagcgtgggttgccgctcctgcggcgccgttcttccaatcggcggtctctgcctttccgtattgatagacggatgcggttttgaggccgttttgttcaaaagctcgggtttctgccagtgtgactggcttgccgatcatccaggattcagtgccggggcgtcgctgtgacacgtaacggacagctccaaggtgccctgcatttttaatggatgctgcgctggggacgcctgctgcgtagtcgatgacggtgcccttgattgctccaagggcgttggcctttggcataaacatgctggcagcgccgatagtggcaagtcctgtggtggcttttaagaagcctcggcggtttatttgcatgtccaaaagttctcccaaaaataagtattaatcccaccagtaacagtggttaacaataacaacactcatttaaaagggctaggggtgggatttttcgacctttaacgacaccgttatcttgtgatgttgctcacggtgaaaggtttgtttcctgcaaaaacaagaaattgccagaaaaacatgagggtttagtcatctatttcggctacgctcacgtaacctacgcattcgtaagtggtcatgggtccaagaagcccattccaagacttaggagctttatttcgtgagtatttcttcactgacaccgctgcactctttcaaagagccagcaattctgtacgccggtcaggcttctgcctggcagcaggtgatcgctgattccagcgaagaccacatcaccgcaacgcacctgcgcgagctcctgtctcgctcccgtgcaaagactgcacctttcgctcgccaaatcaccgccatcgtgcctggctcacttgctcgtcttgaggaactgacccgcgaagacgcacaaatcggtgcagacatcgacgcacagcctgccgtttccattccaggcattctgctgggacagatcgctgcaacccgtcagctgcgtgacctcggactcgatgtcgcagcagcttcccgccttggacactcccagggcattttgggcgttgaagcagtagacaatgaagaagacgttttagctttcgccatcctgctgggcgcagcagcttcccagttcgctggcaagggcgcacatatgctctctgttcgcggcctgtcccgtgagatcatccaggacaccatcgctggtgtcgatggggtagaggtctccctgcgcaacgctcgtgcacactttgttgtctctggtaagccagaggcactgaagaaggctgctgctgctctacagcgcgcagctgatgtttacaacgaagacatcaacgaaaagcgcaagggtggatccctggcagagcctaagtttgactacttggatgtggccattcctttccaccactcctccatgcaggacgcagccgacttggctgtcgagtgggcaaccacctgtggcctaaacgtcaacgcgcgcgcgttggcagaagcaattctagttaacccagctgactgggttgagcagatcgcaaacctcaaggctgattacgttctttccctcgatgcaggcgtcagccgtttcaccgctccattgctagacggtcgcggaatctctttggttcctgcgttctccgctgcagagcgcgacaacttggctcgccctggcttccacgttcctaccgctgaggattggtccgagttcgctccaaagctggttaagcttccaaacggtgagcacaaggttctcaccgggttctcccgcctgactggttattccccaatcgtcctggctggcatgaccccaaccaccgttgatcctgagatcgttgcagctgcagcgaacgctggacactgggccgaaatggccggtggcggacagtactctgaagaagtcttcaccaagaacaaggaaaagctcgtttccctgctcaaggttggacgctccgcacagttcaactccatgttcttcgaccgctacatgtggaacctgcagttcggtgcacagcgcatcgtttccaaggcacgtgcaaccggtacctccatcaacggtgttgttgtctccgctggtatcccagaggttgaggaagcaactgagctgatcaacgatctgaacgctgatggcttcccatacgttgcattcaagccaggcaccgtggatcagatccgcgcaaccctgaagattgctgatgcaaacccagagaccaagatcatcatccagatcgaggacggacacgctggtggccaccactcctgggtcaacttggacgatctgctcctgaccacctacgcagagctgcgttcccgcaagaacgttgtcgtcatgatcggtggcggcatcggaacccctgcaaaggctgcttactacctgaccggtgaatggtccaccgatttgggcttcccagcaatgccagtggacggcatcctcgtgggtaccgctgccatggcaaccaaggaagcaaccacttctcctcaggtcaagcaggcactggtcgacaccccaggtgttgatccacacgacgctggcggctgggttggccgtggcgatgctcgtggtggcgtgacctctggtctgtcacacctgcacgctgacatgtacgagctggacaacgattctgctgcagcttcccgcctgatctcttccatcgattctgatgattacgcagatcaccgcgaagagctcatcgaggctatcaacaagaccgctaagcctttcttcggcgaggtcgaagagatgacttacgcagagtggatccagcgttgggttgagcttgcttacccaactcaggacccaacctgggatgatcgtttcctcgatttggttcaccgcattgaagctcgtctcaacgaggcagagcacggcgccatcaccacactgttcccagaccatgcgtctgtggaaaatgaggaagaggccgtcgaaaagcttcttgctgcttacccgcaggcccgcgagatccaggtctctgcgcgcgacgccgcgtggtttattggtctgtgccgcaagcaccacaagcctatgccttgggttccagcaatcgatgctgacctagcacgctggtggggccttgacaccctgtggcagtcccagaacgagcgctacggcgcgaactcagtccgcgttatcccaggaccagtctccgtcgccggcatcgaccgtgttgacgagccagttgcagagctgctcggccgcttcgaagctgcctgcgttgacgctctcgacggcgagccagaagagatcttcgctcgcctcaatgagtccaagaacgagcgcgaattcctgctggctaccccacacatcgtgtggcacggcaacctgatcgacaacccagctcacgtcctcaacgagggtgctttcgagctcatcgaggaggatggctactgggtcatccgtatcctggctgattcctacttcgacgatctgccagttgagcagcgcccatacctggttcagcatgttgacatcccagttgagctgggtgacgctgttgcaaccggtggctccccagttgtttcccgtgagaagctgcctgagtctgtcttcgcacttcttgctggcgttgctggtgttggatctgtttccgctgctggcgatgagatcaaggcacttccagaggcagttcaggacggcaccccattcggcaccgtccgcgattctttcaccctgcctgcatccctgctgaccgcacacaccgcagtcaccggcgcagcgctggaagcacacaacgttggcaccccagacgtcctgatgggcgcttgctggccagcaatctacgcggccctaggcaccggtaagctctccgatggctatccagtcatcgaaggcctgctcaacgcagtccacctggatcaccttcttgatctgcgcatcccactcgaggagctggcaaacggccgcaccatcgatgttgaggcacgcaccgactccatcgaagagtccgcatccggccgtatcgttaccgtgcgcatcgtgctcaccaccgaaggcgaagtagcagccaagctggttacccgcttcgcaattcgtggacgcatcaccaccaacgaaatggctgcaccagcagattcctacggcgcacgcgacgaagttgtcgaggcaacccctcgttccttcatccgccaggcaactgtttctgcacctgcagacatgaccccattcgccatggtttctggtgactacaacccaattcacacctctgacaacgctgcaaagcttgttggcctggacgcagctcttgtccacggcatgtggctgtccgctaccgcacagcacctcgctggtcttggctctgaggtcattggttggacctactccatgtacggcatggttcagctcaacgacgttgttgacatcaccgtcgagcgtgttggccgcgcaggtctgaagcctgcatacgaggtcacctgccgcattgatggcaacgttgtctcccgcggacaggcactgctcaaggctccttccaccgcttatgtttacccaggccagggcatccaggctaagggcatgggccagggcgatcgcaccgcaagcgcagaggctcgcgctgtgtgggagcgtgcagatgcacacacccgcgcaaacctgggcttctccatccagcaggtcattgatgaaaacccaactgagctgaaggtcggggacaccaccttcgtgcacccagctggcgttttgaacctcacccagttcacgcaggtcgcgctcgccgtggttgcctacgctcagaccgagcgcctcaaggctgcaaacgcaattgtcgacggctccctctacgcaggccactccctcggcgagtacaccgcactggcatccttgggcaacatcttcgaactcgaaggcgtcatcgacgttgtgttctcccgcggttccgcaatgcactccctggttccacgtgatgagaagggccgttccaactacggtcttgccgcattccgtccgaacatgatcaacgttgcagccaccgaggtggagaactgggttgaccgtgtcgctgaagaatccggcgaattcctgcagatcgttaactacaacgttgatggccagcagtacgcagtcgcaggtaccttggctggcctgaaggccctcaaggcttctgcatctgcaaacccacgtgcttacgtgaacattccaggcattgacgtgccattccactccagcgtcctgcgcccaggcgttcctgctttcgcagagaagctggacgagctgctgccagagaccatcgacattgatgctcttcgcggccgctacatcccgaacctggttgctcgtcctttcgagctcacccagagcttcgtggatgccatccttgctgttgttccatccgagcgcctcaagggcatcaaggtggaggacaccgacgagaacaccctggcacgtctgctcctcatcgagctgctgtcttggcagttcgcatcccctgtgcgttggatcgaaacccaggctctgatcatcgataccgtcgatcagatcatcgaggtcggcttggcagcatcgccaaccctgaccaacctggcactgcgcaccatggatgtcattggcaagtcccgcccagtattcaacgtggagcgcgaccaggacaccgttatgctcaacgatgttcgccaggcacctgttgctgaggttgaagaagaagcagttgaggaagcacctgcagcagccgcagctccagcagctgaggcaccagttgctgcagctccagtagccgcagccgcacctgcacctgttggaaacgcacctgaactgaagttcaacgctgccaatgccatcatggttctcttcgctgtccagaacaagatcaacattgatcagatcaccgcagcggatacctctgagaccctgaccaacggtgtgtcctcacgccgtaaccagatgctcatggacatgtccaccgagctgtccgtcccaaccatcgacggcgcagctgacgctgacgtagctaccctgcagggacgtgttgtcaccgcagctcctggctacaagcctttcggaccagttctttccgagaccgttcgtgcacgtcttcgcgcactgaccggtgcagcaggtctgaagacctcctacatcggcgatcgcgtgaccggcacctggggacttccagaaagctggaccgcacacgttgaggttgaattgctgctgggcacccgcgaaggcgagtccgtccgcggcggcaacctgggtagcctgcctgctaacgcatccagcaagggcgacgtcgatgcgcttatcgacgcagccgtgcagaatgttgctgcagccaacggcaccagcgtctccatgtcctccggcggtgcagcttcaggtggcggagttgttgattccgcagcacttgatgcctacgcatccaccgtcactggtgaagaaggcgtcctggcaaacgttgctcgcggcatcctgtctcagcttggtctcgacaccaaggacgaggttgaaggcgcagagatcgacaccgaactctacgacgctgtcgaagcagaactgggcaccggctggctgaagcttgtcaccccagtgttctccgctgatcgtgcgatcttgttcgacgaccgttgggcatctgcacgtgaagatctggcacgccttgccaacggcgaggatattgccgtcgagcgctttgctggaacgggggagaccgtcgtcaagcaagctgcatggtgggctgagcacgttgaagacaccgctctcgctgcaaccctgaagcaggtttccgaggtggctgcgaagccagccaacgagccacacatcgacgatgttgcgctggttaccggtgcggctcctgagtcgatcgccggtgcagttgcggctcgcctgctgtcccagggcgcgaccgtcattctcaccgcatcgaacgtctcccaggcgcgtaaggaatacgcacgcaagctctacgctgcgaacgcaacccctaacgcaaagctgtggattgttcctgcgaacatgtcctcctaccgcgatgttgatgcagtcatcgattggatcggcaacgagcagcgcgtcaccgtcggcagcaccgtcaccgtgaccaagccagctctgaccccaacccttgcgtacccattcgcagctccatccgtatccggtaccttggcggatgcaggcccacaggctgaaaaccaggcacgcctgctcctctggtccgtggagcgcaccatcgcaggacttgcagatcttgcatcccgcggtgtcgatggacgcgtccacgttgtactcccaggttccccgaaccgcggaatgttcggtggcgacggcgcttacggcgaagtcaaggctgctttcgacgccatccttgccaagtggggctccgagaccggctggccacagtttgtctccctcgcacaggcacgcatcggctgggtcgcaggcaccggcctcatgggtcgcaacgacgtgctcatccctgccgctgaaaagctgggcatccacgtctacacccctgaagagatctcttccgaactgctgggtcttgcatccgcagaatcccgcgaaaaggctctggaagcaccgatcgattacgacctgaccggtggactttccggtggcgtatccatcgcagcactggcagcatccctcgagtccgacgcagtagagaccacctctgcagcagaagacaccatcaaggcgcttccatcacctaagcacccagagcagccagtgggcacgccagttggagaggtcaagaccgatctcgaagacatggttgtcatggttggcgttggcgaagtctcctcatggggctccggacgtacccgcttcgaagctgagtacggcatccagcgcgacggctccgttgacctcaccgcagcaggcgtccttgagcttgcatggatgatgggtctgatctcctggagcgaagatccaaagccagcctggtacgacgctgacggcaccgaagtgcctgaagaagagatctacgagcgcttccgcgacgaagtcatcgcacgatgcggtgttcgtgagcttgtcgacgacgcattcctcgtcgacggcggctccctcgacgcagctgaagtcttcctcgaccgcgacatctccttctccgtaacctctgctgaagaagcacaggcctacgtcgatgcagatgcttccgtgaccgttgaagaagcagacggcgaatggatcgtgaccaagaagaagggctccacctccttcgtgccacgcaaggcaaccctgacccgctccgtagcaggccagctgccaaccgacttcgaccctgccaagtggggtatcccagcctccatgatcgatgcactcgacaacatcgcagcgtggaacctggtcactgcagtcgacgccttcctgtcctccggcttcagcccagcagaactcctgcagtccatccacccagctgacgtgtcctccacccagggcaccggtatcggtggcatgcagtccctacgcaagctgttcgtcaaccgcttcctcggccaggatcgtccatccgacatcctccaggagaccctgccaaacgttgtggctgcacacaccatgcagtcctacgtcggtggctacggccagatgatccacccagtggcagcatgtgcaaccgcagctgtctccgtggaagaaggcgtggacaagatccgcctcaacaaggcagatttcgttgtcgccggtggtatcgatgacatccaggttgaatccctgaccggcttcggtgacatgaacgccaccgcagacacccaggcaatgctggacaagggcatcgacccacgcttcatctcccgcgcaaacgatcgacgtcgcgcaggcttcctcgaagcagcaggtggcggtaccgtcctcctggcacgtgcatccgttgctgctgaactgggactgccagttctcgcagttgttgcacacgcacagtcctacgccgatggtgctcacacctccatcccagcaccgggacttggcgcactgggtgcagcacgtggtggcaagaagtccgtacttgctcgcgaactgaacaaattgggtctgaccccagatgacgttcgcgtggtctcgaagcacgacacctccaccaacgccaacgatccaaacgagtccgagctgcacaacctgctgtggaagaccattggacgcgaagccgacaacccgatgttcgtcgtctcccagaagtcccttaccggacactcaaagggcggtgcagcactcttccagatcggtggacttgtctccatcctggaaaccggcaagctgccacagaacgcatcccttgactgcgttgacccagagatggaagcaaagggcgagaacttcgtctggctgcgcaagccactggatctcggcgcaggctccattaaggccggcgtacttacctcactgggcttcggccacgtggctgcagtcgtcgtgctggcaaccagcggcatcttcgagcaggcaatgcgcaacgcaggcctcgacgtcgaagcatggcgtgcacgcgcaacccagcgcctgcgcaccggtgcaaaccgcctagaagctggcatggttggccgagcaccattgttcgagcaggtcgacggacgtcgcctgccagagcatggcgctcaccaagcagagatcaacttgcttatcgacgctgacgctcgcctcggtgctgacggcatctaccagggctaaacgttagatagctaagaaagctgcattccctaacgggaatgcagctttttgtgttcctagtgcaaatcgaaatctcatgtgatttacttaaaacctaattaaatctactatcggagatctcatgaaacttctcaagtttgctgcagcaggaaccttcgcactagccctggctggctgcacacagactgagtctctcgtagcaacaatcgaatctgcaacctctgcagcacaggcatccggaaacgacgtagaaggagaccaaacctccgcgttcgaactctccgttggcgaatgcttcaacgacacctacgaagaagaaatctccgaagtacccatcgtcgactgcgcagaacctcacgacaacgagatctactacctctacgacatcgaaggcgacgacttcccaaccgacatcaccaccacaggctacgaaggctgcctcccaacatttgaaggcttcgtaggagctccttacgaaacctccatctacgaggtctacccaatgaccccaacctttggctcctggacaaacggcgaccgcgaggtagtgtgctccgtgtacttggccaccggtgagcagatgaccggaaccgcagcaggaaccgcgcagtagattttggatagggaattttgagctaccaaaaattgttagaagacttcatcacagaagcacgggatattacagattccatgattgccaatgcgcagcgttacggcatcatcgacagcaatccccggggtgaaaaatccttgaattcggtagcttcaaaattttgaagaggaggacttcaccaaagaatccttagcgttattctttggtgaagggttggttcgagtccacggcggtcaatggaagatcatggccggtgaaagaactgaaaacctccaaatctcacttgtcttttacgtggacttcggagaaaagggaggaacactcccatatgggaccatcaactatttctcagatagccaggatcccactgggctgaaaaggctctttgacatcagtgtttagctctcgaacagctctttcagatttttgtcgatctgtgggatgtaattctcagagacgttaaaaagcccaaggtgaccggcgatgtcttcgatcactcgaagctcgctgcctgggatgagtgcttgttctgcggcacagtcacgaacaggaaagaacatgtcctcgctgatgggcataacgaaggtcttagccttcactcggccaagagccgctgccaagtcgccgccggtgtggcgagagacatcgccatgctgccacttccaagcgttgttgagcaaggtattaggatccatggacatgaacagcggatccaggaagtccgcgagcactgactccttactttcaagtcccaggcgacgccatgcctcctgcttccagaactctgtggaaaatcccatggcagcccaaagatgcgattgacggcgaagtccatcagctacctcttcatgggaggagtattcgccgccattgaaccctggatcggcctcaacggtctcattaagagtctgggtgaagatgaaatcatgaggagtgttcttcgcagtgcccgcgatcggagctgctcgatgaacttggtcagggaagcgaacaatccactcataggtttgctgcgcacccatcgaaccaccaacgacggcaaagagctcggtaataccaaactcttggcgcaagagccggtcctgggcaacgacatcatcaccaatgcgaacattcgggaacttggacatcgagatgctgtcatcagccgtgttggcaggggagaccgacaaaccattaccgatttggttgatggagatgatgaaatactttgatggatccagcgcatgatcagtgccgatgtactgctggaaccaggtctgatgggttccggagtaccacgtcggaatgaggatggcgttggacttgtcctcgttgagcgttccagctgtagcgtaagccaaccagcaatcctcaatcacacccccttcttcgagttcgagccggccaatggaagcggtttcgtatgggccctgaacctctgcggtgtaaaaactattgtcgagcatgaaaactcctaacagtatggggtgtaggtcacaatatacgacaaagttaatctacggaacactcgggctttgatcaagggtgtacagactcgagaatccagccatcgttagcggtgaattccagcgttgcagcagtggggaagagcgtgaagtcaatccttggttcagagcaaaagtcgaggtttgacctgcgatatcgcacccatttgtattcgcccgtgtcactttttaggagaagaaaattggtttgttcgtctggccacttatctggccagggggtatctccgacgtcaagttccgccttcgcatagtcacttggcgtgtaggggcaaacgactgcaaattcggaccattgatcgttgtaaatgtcgttgagggaaacttgagctgtagctgtctcaatggaggtgagataactggaaagctcgtcgtttgccccacacgcggtgagcgtgagcaatgcggcggacaggccgatggctctcttcgggctctgtagcatgatctacagtgtacgtaagcgtgtatttttgcactttggaggaaatgatgaacccccattgatgcagttcaatgggggtaaattgtgccctggagaggaatcgaacctccgacacccgctttaggagagcggtgctctatccactgagctaccaaggcgtaccgaactagattacaacacgcgggggtgggaagaaaaagagggggttgcttttgcttcgacaagctgtttccacaggtaaggtgggagttaatacttcccgaccttaaggagcagaaatgaccaggtataagccttcgttccatgatgtgcagcgtcgtccaattgtggtcaatcagatcactaaagatagtgttccagtgctggcggttgatgagatccaagatgatggaacgcctcgccggattatgctgctcaacaagtatgatgccaagcagttgagtgcggcatgtgaccgttatttgcaggagattttctccgcgacatttgcgggagttaatacggatttgtctcccgatgatatggccaaactgtttggtgatgaataagaaaaaagagccgaaaggctcttttttgcgtttaggctaatgcttcgattttggcgattacttccgcagctaggggattagttgcgtgggtgccatcggagtagcgcacggttgggacgatgcggttgccgtcgttgactgacttaacccactcgccggcttcctcatcttggtcgacgtcgatgaggtcgtactcttggccgtcgagacctttgaggagggatcggcagtaagggcaccaatctgtggcgtaaatggttacgttgctcatgttgtttgctccttaaaccttgatgtagcgctggaacttgtaacgatactcgcctgaggtaaaccactcggattcgtcatcgaggttgaagttcgccgggatttcgggtgcgtagacgggagtggaaacatcgaaggtggcgtcgataagcgttatttctaaaacgtcggcgctgccgacggtggccttgtagacctcgccgccgcccatgatccagccgcttttagggatttcggtgaccactgtgccgccggcggaccagtcgccgggctcgcgtgaggagagaatgaagttctcgcggccgggaagcggcttgaacggcaaagactcccacgtgcgacgacccatgatgaccggctggcccatggtggttttcttgaagtgtttgaggtcttccgggatgtgccagggcatgtcggtgccgtcgccgatgatgccgtcgcggccttgtgcccaaatcgcaccgatcatacggcgaccttgccgcggatcaatgggtgtggatcgtagccggacacggtgatgtcatcgaagctgtactcaaacatggacgctgccttgttgagctccaaggtggggtaggggcgagcttcgcggctcagctgctccgcgacctgttccttgtggttgtcataaatgtggcagtcgccgccagtccaaatgaactcgccgacttccaagcctgcctgctgggcaaacatgtgggtgagcagtgcataagatgcgatgttgaaaggcacacccaggaacatgtccgcagaacgctggtagagctggcaagacagtttgccatcggcgacatagagctggaaaagcaagtgacaagggggaagagccatgttttcaagctcggaaacattccacgccgagacaatattgcgacgtgaatcagggttgtttcgcagagtttctaaagcacctgagatctggtcaatgtgacgaccatcaggggttggccaagaacgccactggacaccataaacagggcccagctcgccgtcctcatctgcccattcattccaaatgcggatgttgttatcctgcagccatttgacgttggaatccccctgaaggaaccacaaaagctcacccacaacagagtggaaatggaccttcttggtggtcagaaggggaaaaccttcattgagatcaaagcggatttgttgtccgaataaagaagtagtgccggtgccggtgcggtcgtccttgtgggacccttcttcagcaatcttccgaagaaggtcttcataaggcgttggaacagtcatgccgtcatcataacagcgttagtaagttccattctcctcgtagaacttcgcgcacatctcgagaagttcatctgcaagttcagggcgacagatcaagatgtctggcatgtaggtgtctttgttgttgtaggtcagctcggaaccgtcgagcctggagcagtgcaagcctgctgccttgcagacgccgactggtgctgcggaatcccactcgtattggccgccggcgtggatgtaggcgtcgtagtcaccgaggagaacgtgcattgctttagcgcctgcggatccaagggccttggtttcaaagccgagctgctctgcgcaagatagagcaacctttggtgggcggttgtgggagatggcgatgaccttggagtaagggccagtcacggcgcgggcatcagcggagtggaacaccacgccaaggtcggggaggccaacagcggcgtgggtgggaacaccgttttctaccagtgcgatgtgtactgcccagtcctggcggccggtggcgaattctttggtgccgtcgaggggatcgatgatccacacgcggtccttggataggcggtctgggttgtcggcggcttcttcagacaggaatccatcgttggggcggtgctgctccaacactcgagcaatccaactttgtgcgagttcgtcgccggcatcaccgagattccgacctcttaacaccccaacattgcggacacctttgaggatttctccggtgccttgggcgagacgatgggtgaggatcgaatcatcaatctgagcagtcatgttctcaattctagatgtttggttacattaaggcatggctaaaagcattctttcccgattccgacctcaagtagcggagtggttccgggatgtctttgcatctccgacccctgttcaggagggaacgtgggaggcggtatctaaggggaagaatgccctcgtggtggcgccgaccggtagtggtaaaaccttggctgcgtttttgtgggcgttagattccctcactgaacaaacaggtcaacaggttttagacacgggaacaccggtgcctgttcgtggtgggaaagtgaaagtgctctacatttccccactcaaagcgcttggcgtggatgtagaaaataatctgcgtgcaccgttgaccggtattgcgaggactgcctctcggatgggtttggatgtgcccaatatcactgtggcggttcgttcgggtgatacgccatcggcggagcgggcccggcaggtgcgtaagcctccagacattttgatcaccactccggagtcggcgtatttgatgttgacctcaaaagcgggggcgaccctttcggatgttgatgtggtgatcatcgatgaaatccacgccatggccggaaccaaacggggagtgcatctggcgttgacgctggagcgtttggaaaagctcgtggggcggcctgtgcagcgagttggtttgtctgcaacggtgcgtcctttggaaacggtggcgggtttcttgggcggtggcagacccgttgagattgtggctccacctgcggagaaaaagtgggatctcactgtcactgtgccggtggaagacatgtcggatttgccggttcaggagccgggatcaactattggtgaactagtcatggatgatccgttggggattactggcgaatcagcgctgcctactcaaggctcgatttggccacacattgagcagcaggtgtacaaccaggtgatgtcggcgaaatcgaccatcgtgtttgtaaattccaggcgttccgcggagcgtttaaccagtcggttgaatgaaatctgggcgatggaacacgatccggaatcgctgtcgccgcagctgcgaagagatccggcgcagattatgtcgtcagcggatgtggcaggaaaagcaccacaggtgatcgcacgtgcgcaccacggatccgtatccaaagatgaacgtgccaccaccgaaaccatgctgaaggaaggtcggttgcgcgcagttatttccacctcctcgctggagttgggcattgatatgggtgccgtggacctggtgattcaggtggaatcgccaccgtccgtggcaagtggcctgcagcgcgtggggcgtgcggggcacacggtgggggcgacgtcgataggctccttttatcccaagcaccgctccgacttggtgcaaaccgcggtgaccgtgcagcggatgaaggaagggctgatcgaagagatccacgtgcccaaaaacgcgcttgatgtactggcacagcagacggtggcggctgtctcgattaaagatgtgcaggtcgatgagtggtacgagactattcgcaaggcgtatccgtaccgggatttggcgcgcgaagtcttcgattccgtcatcgacctggtcagcggtgtgtatccctccacagattttgccgagctgaagccacgtgtggtgtacgaccgggtttcaggcgtgctggagggccggccaggatcccaacgcgtagcagtgaccagtggcggaacaattcccgatcgaggaatgttcggagtcttcctcgtcggcgatggtccccggcgcgtcggcgagctcgatgaggaaatggtctacgaatcccgcgtgggcgatgtgtttacgctcggggcgtcgagttggcggattgaagagatcacccgcgaccaggtactggtcactcccgcgccgggtcacacgggtcggctgcctttttggacgggcgatgccgcaggccggcccgctgagctgggtaaagctttaggcgcttttcgacgctcgaccctcaccgatccatccagctccggcttggaaggctgggcgcacgacaacctgatcgcctttttacaggagcaggaagaatccaccggtgtgttgccggatgagaagacgttggtgttggagcgtttcaaagatgaactaggcgactggcgcattgtcctgcacactccttatggacgaggagtaaacgcagcatgggctttggccgtcggggcgaaaatcgctgaagagaccggcatggatgcgcaagccgtggcaggtgatgatggcattgtgcttcggttgccggaaggggatgaagatcccagcgcagcgttgtttatgtttgaggcggaagagatcgaaacgctagtgacagagcaggtgggtaactctgcgctgtttgccagcaggttccgtgaatgcgccgcgagggccctattgctgccgagacgaaaccccggcaagcgcgcaccgctgtggcagcaacgacaacgagcagcacagcttcttgatgtggccagaaagtacccgagtttcccgatcattttggaaacagtgcgcgaatgtcttcaagatgtttacgatctgcccgctctgaagaatctcattgaggatctacagctgcggaaggtaagaatcgcggaagtcaccacccagcagcccagtccttttgcctccgcattgctgttcaattacaccggtgcattcatgtacgaaggcgacagcccgctcgcagagaaacgtgccgcagcgttggccctggatccggcactgttggcgaaattgctgggtgaggtggagcttcgacaattactggatcccgacatcatcgcagaagtgcaccaacaattgcgcaggcaaggcgatcgtgcggcgagaaacaatgaagaactcgcagattctttgaggattttaggaccgattcctttggatgaattgggcgaacacatcacctttgaaaacccagacctggaggatcgagcaatgactgttcggatcaacggtcgggaacatttagcgcaggtcttggatgcacctttgcttcgagatgccttaggtgttcccgtaccgcctggtgtgcctgcgcaggtagaaaccattacggatgcgttggaacagttagtcaacaggtgggttcgtaccagagggccatttactgcgaatgatttggcagaagcctttggactgggcatcgccacggcgatcaccgcccttcaaagcgcacctgtgattgaaggccgctaccgacaaggcgtggacgtgcaggaatactgtgcgacagaagtgttgtcgatcataaggcgacgcagcctcgcagcagcgaggaaacaaaccaggccggtatcgcaatcagcctttgcgcgattcctgcttgattggcaacagatcgcaccggtgggcgccacacctgaactccgaggcgttgatggcacctacacagtcattgaacaactcgccggtgtacgtcttcccgccagtgcgtgggaagatctcgtgttgccgcgccgggttgccgactattcaccgatccatctcgatgagctgacctccaatggggaagtcctcatcgtgggagcgggccaagccggaagccgcgatccgtggattagcttgctgcccgtggattatgcggcgcagttggtgggggaggcgtcgacaagcatgagcccattgcaggacgccgtgcttgaccagctgcgtgcgggaggcgccttcctgttttctgacattctcgaagagaatttcggctacaccacagcccagctgcaagaagcgatgtgggggctggtggaagcaggcctggtcagccctgatagcttcgcgccgatccgcgcgcgcctagcgtcgggaaccacggcgcatcgggcgaaacgtcgaccagcgagatcccggctgcgcacccgcaccagcttcgcgagcgacgtgcccccagacatgcgcggacgatggacgctgtccgtgcaacccgccgacgccaccagccgctccgtcgcacacggcgaaggctggctcgaccgctacggcgtgctcacccgcgggagcgtcgtcgccgaagacatcgtcggaggcttcgccctggcctacaaagtgctctccggcttcgaagaaagcggcaaagcgatgcgcggctacttcatcgaagggctcggcgccgcgcaattctccacgcccgccatcatcgaccgcctccgcggccacgacgattcccccgacgtcgaaggctggccctccggcgccaccgacccagacgtctacctcatagccgccgccgaccccgcaaacccctacggcgccgcacttccctggcctgagcaggggcccagccgcgccgccggagctatggtcgtgctttgcgacggactcctcctcgcccacctcacccgcggcgggcgcaccctcaccgtgttctccgacaatatccccaaaatcgcgacagccctaatcacatacgaaaggctcacggtagaaaaaatcaacggcgacaacgtcttcgactccccactcctggaacaattccgcaaacacggcgccaccatcaccccgaagggaatgcgatttcgaccaccagtggcacgggaaaccccctcagatacgcttcccaccaggacttttcgtggaggcttcggacggcgctaacctgatgacatgccagaaggtgattccgtattccaactctcccgcaaacttcaattcatgcgcggaagagaagtgctggaaacctccctgcgtgtgccatcagtggcacttcacgatttcaccggtcaaaccgtcaaccgcgtatggccctacggaaaacacctcttcatgcaattcggtgaagagatcctccacacccacctcaaaatggaagggacgtgggctgtccaccgcaaaggcgatcgctggcgcaaacctggacacaccgcgagggtagtgcttgtgctgtcggaaaacatcgaggtggtggggcattccctcggctttgtcagagtgttccccgcaaaccgctactccgaagagatcgcttacctcggccccgacgtccttgccgaagaattcgacatcaacaccgcacggaacaatattgcatcgaacccttcccgaacaattggcgaagccctcctcgaccaatccaacctcgctggagtaggcaacgaataccgcgctgagatctgcttcctcatgggcgtccacccggcgacacaagtaggatacgttgacgtcgaaaaggctctgaagattacccgaagactcatgtgggaaaatcgaaattcgccgattcgagtgaccaccggggttcgacgcgccggggaatccacctatgtgtttgggcgtaacaataaaccgtgcaggagatgccgaaccccaatcgtgaaagccgagttgggggagcgaataatctggtggtgtccgcgctgccaaccgctaaactcgtgaagcatgagactaatactcaacctgatttggttattcttcggtggcatttggctcgcgttgggatacgtattcttcggaatcatcgcatgtatcttcatcgtgacgattcccgccggtatcgcaagcttccgcatggctaactacgcgctgtggccgtttggtaggacggttgttcgtaatcctaaagccggagggttttctgccctgagcaacggactgtggtttatcattgctggactgtggctggcgatcgggcacctcaccaccgcggctgcccaggcgatcaccatcatcggaattccactggcgatcgcaaacatccgaatgatccccgtgacgtgtttcccgttcggcaaagaaatctatgacagcaaccgcattcccttcggctacgaaccgatggttaagttttaattcggcgacggactaaaacaaacaacacataagccacgatgagcgcgatacctacgtaaatgatcgttgaatagctctcaaaccacatcgacaccgtctcccattccgcccccaaccacacaccagtccaaatcagaaccgcattccaaatggtgctgcccaccgcagtgagcacaccgaagagaaccggattcatcttgtcgacgcccgccggaatcgaaatcaaacttcggacacccggcaccaaccgaccgaaaaacaccgaatacttcccgtacttttcgaaccacgatagggatttatccacgtcggtcgcgtcgacaagccacatccagtcggcgacctgccgcaaccgtgccgccccgattgagcgccccaacccgtaaagcaaaaacgctccggaaaccgacccgatcaccgaccacataagcgccgcccacacattgagatcgccttgcgtggtggtgaaacccgcgagcggaagcaccacctcacttggaatcggcgggaaaacgttctccaaaaacaccgcgacacccacgccaacggcgccgagtgcctccatgatggagataacccaatccaaaatcatcgtttactccgcgcgatcaccgcatgtgaaacaagcggatacgcaatgagcatcccccacgcccactgcacattaaacacccaattcaacaccgcaaaacccaccaaaaacagcagcgtcgcgatcacacaagcagcgtcagatctttgcggcatagcgccatcctagcgatttaaaagcttttcgacgtaaacctgccttgtcgcaaagtaaccgcctctaataacgaagagtgttgcaaccgcaaaaagcacaaagattgttcggaagctgcctgtcgcatcgacaatgaaaccagtcaacaagggaccgaaacacgcaatcgtataacccaaaccctgcccgaaggaactcaacgcagaagcaccagcactagtttcagcacgaatattaatgagcgtcaacgccatcgggaacgcaaggggaccaagaccagacaacgtcgcccacaaccacggcgcaacatccggagccaaacaaaacccaccattaccgatgagaaacatgacactggcgataacaaccatcgggaagcagttagtgaaacgcgtcaccaaccacggtcccagaatgttcagcggcaatcccaaaattgaccaccagcctaacaacaccgcaccgagctgaggatcacctaccatctgcggcataaaacccatgaggatatacgtcgcaaacgaagtaaacccaaacatcaacccgagccccacaccaaccgaagacttccacacaggaagagaaaccttcgacggcgccgcaacaaccctggcaccctgcaaactcaacagcggaatccacgaaatcgccgcaaccaaccccagcagcgcccacgaaccgagcgacaccctccaaccggtcaaccccacatgtgtagcccactgagaaatcggcacggcaagcgtcggagcaagtgcctgaacaatctggaacgacaccagataagttgtcgacattccaccgacgtgacgcggaaaatactccctaacagcaatcggaagcaacacattggtaactccgatcgcaaacatcgcgaacacagtaccgaccatcaacagcgaagcaggtccagcgacacgaataatctgaccggcagcagtcaacagcatggcaaacatcaacagttgggaagtagtgaacttcctcttcaacgacggaagcgcaaacgcagcaaccgcgaacatagcagtcgggatcatgcccaacacaccaataagagaagcactaacccctaaatcatcccgaatctcagaaaccagcggagctaaagcagtaatagctgttcgcagattgaacgaggtcaggatgatagcggccagtgctatgaggcgaggattcttcacgcccctgaccctataagcaagcgactacctatttgcgcggtaccacttaatcagtgaatcagtggaagaatctcccgagtcaacatcctcttcaccagagacagccggagcgaggtcatttgcctgctgtttgcccagttcaacaccccattggtcgaaggagttgatgtcccaaatcacgccctgaaccatcacgatgtgttcgtacaaagcgatcaacgcaccgagaatagaaggggtaagttcctccgccaaaatggtggtggttgggcgattacctggcatgaccttgtggttgaccagctcaggtgcgacaccttccgcagcgatctcttcagcgttcttaccgaaagccaaaaccttggtctgtgcgaagaagttgctcatcaaaaggtcatgcatggtgcgctcaccggcaggaagatcctgctttggacgagcgaaaccaatgaaatcagctggaacaaggcgagtgccctggtggatcagctggaagaaagcgtgctggccatttgtgccaggctcaccccagtaaatttcgccagtgccagtggaaacaggggagccgtcgcggtggactgacttgccatttgattccatggtcagctgctggaggtaagcagcaaaacggctgagatcctcggaataaggtaggacagcgtgggtttctgcaccatagaaatcggagtaccagacaccgagcagagccatcaagattggaacgttctcttcgaacttggtggtgcggaagtgttcatccatcgcgtggaatccaccgaggaaacgcatgaagtcgcgagggccgatcactgccatgagggaaagaccaactgcggagtccacggagtaacgacctccgacccagtcccagaagccgaacatgttgtccgtgtcgataccgaactctgcgaccttttcagcattggtggacactgcgacgaagtgcttcgcgacagcctcttcaccgagcttctctaccagccaagcacgagctgcacgagcgttggacagcgtctcctgggtggtgaaagttttcgaagcgatcacgaacaatgtggattctgcatcgaggtcttccaacacagaaacgaggtctgctgggtcgacgttggagacgaattctgctgagataccagcggtcgcgtatgcacgcagagccttcgtagccatggctggtccgaggtcagagccaccgataccaatgttgacgatcttcttgatcgtgtggccggtgtgtcccaaccagttgcctgagcgcagcgcagtagcgaagtcacgcatgcgtcccaaaacttcgtggacatcagcagcaacatcttggccatctactgacagatcagcttcggcaggaaggcgcagcgcggtgtggaggacagcgcggtcttcggtgttgttgaggtgttcaccggcaaacatcgcgtcaatgcgttcgcgaaggccagattcttcggtcagtgcaaggagcttggtgagggtggcgtcgtcaagcagattcttcgacaggtcgacgtggaggccagccgcggagaaggtgtacttctcggcgcggttttcttccttgaaaagttcacgcagagtggttgcctggaagtttgagtaatgatcggtcaggtcttgccaaacctgggtggtcgaaatgtccgccatgaaaactcctttattgtcgttaaataacatcttcaggttagcttgcttttgtggccaagcgcatcgaagagtgttcaaagtgggaaacacgacaaatttaggtgcgtttattgggctgcttttcgacgtggccatccggctacttggcgtcctccttaacccaacgcttgtggtggcgtgcccggtgttgggcgactgtttgcgcccatctcgcatttttgggattgagcggcccgttgggttctgacactgcccatgttccgtctcccatgagccagacgatgatgccggagaagggatcgagaaggtaggtgactcggccgtcggttttcatgttgtggtggtgttgacagaggcagccgattccgcctaggcaagtttctccgccttcttcgtaggggatgcggtggtcggcttgggttttgagcgctgggactgaacagccagggaatcggcaggtgccatcacgaccaatgagtgcgtcacgcaacgctggtggaggatcgtgtttgtcggtgctgattttggcagccgcatccatgtcttgttctttgttggctttctctgaccagaatgttccagtcttggcatccaaccagccgattccgctggcccacactggggcgttggcgaggtctttggcggtgtacaagttgaggactaccttgacttggatattgttccgaaggatgtcgctgaaagcttcgccgtaggtgaggtcgtttttcttcgcgtgttgggtgacggcgtcgttgatgatgtgcccgtccacagcatcgacggaggctccgatttcggcggttccgtctggggagaaggtcactccgaaagagctgtcgtcttgggtaccgcgcgaaccggtggctcttgcgtcgtcaagcaaatctcttatttcttttatcttgcgtcctatggacgccgggcttggcagaatctggttggggctggtggcggtgaggtattcggtgaggattgcgtcggcgccggcgaggttgtcggggttgatgccggcgagttcgttgctaatggtgatcagtcgggagaggtcgaggtggtacagcttttgttgcagggctttgagttcgggcaagtcggcgagcgtggcaaacgcgatggatatgcgggagacctgcgcttttgttagacctgtgacgatggcgaggctggagattgcggtggaatggtcatcgtcgtcgcctggcaggtgttcttgccagaagcggtgttccagttctctgagtttggttttttgtcgtgcgggcggactgtctgggttgttgactgcgaagaagttggtaaacaaggaaggcacctccattcgggattctgccctgtaacctatccactattttcttcgtcggaaaccagctcgctaaaaacctgtggataactctgcccatcaacggctaaaaccctgaccaaaactaaaagccctggtcagggtatataaatatttttctacctgtggataacttatccgagttttccgcgtcccatgcgcagcaaaattccagcgagggcagggccttcctcgccgatctcttcacggaattggttgatgattgctacttctcgggtgtgcacgagacgtgttccgcccgagctcatgcgtgtttttccgatggtttgggaaatcttcgtgcggcgtttcaccgcatcgaggatttcgcggtccaagcggttgatctcctcgcgatacttttggatctccgcatcggacaatgggtcatccgtgccagaaggcatcctgatctcgaagttgtcacctgcattagtcatgcacactattctgccacgtctggctgtcgactatgcgtgtccaccccacctagtaggttattggggtaatgaatacttctccttttaccccaggttcccccgatctcatcgatggcttgaatgagcaacagcgtgctgctgtggagcatatcggttctccgctgctgattgtcgctggtgctggttcaggcaagactgctgtgttgaccaggcgtattgcttatttaatgcgttaccgtggtgtgcatccgcagcaaattttggccattacctttaccaataaggctgccgctgagatgcgtgagcgtgtcagtcagctggtgggcccggttgcggagcgcatgtgggtggctacgttccactcggtgtgtgtgcgtattttgcgtcagcaggcgcagttggtggaggggctgaacactaacttcactatttatgattcggatgattcgaggcgtttgctcacgatgatcgccaaggatctggagttggatattaagaagttctcggcgcgtacgttgctgggtgctatttctaatttgaaaaatgagttggttactccgcaggaggctcttgcggatgctgaacgcacgcacaatccttatgaaacagtcgtggccagggcgttttcggagtatcagagcaggcttcgccgtgccaacgctgtggattttgatgatttgattggggagactgttcggattttccgggagcatccacctgttgcggagtattaccgcagacgtttccgccacgtgctgatcgatgagtatcaggacaccaaccacgctcagtatgagctgatttctacgctcgtcggcaagcctgaccaggatccgtctgagctgtgtgttgtgggtgattcggatcagtctatttatgctttccgtggcgccacgatccgcaacattgaagagtttgagcgcgatttctccaacgcccgcaccattttgctggagcagaattaccgttccacccagacgattctttctgctgccaacgcggtgatttctcaaaatgagaaccgtcgacctaaaaacctgtggactgcgctgggggagggcgagcagatcattggttatgttgccgacaatgagcacgatgaagcccgttttattgctagtgagatcgacaatttagttgaccacggcatgagctattccgacatcgcgatcatgtaccgcacgaacaattcctcgcgcgcactagaggatgtcttcatgcgcaccggcgtcccctacaaagtagtcggcggcacgaagttctacgaacgcaaagaaatccgtgacatcatcgcttacctgcgcgttttagaaaaccccgatgacaccgtcaacctccgtcgcatcatcaacacccccaagcgcggcatcggcgatcgcgcgcaggcgttcatcgcgctgcacagcgagaacaatcagatcagcttcgggcaagcgcttctcgacgccgccctcggcaaggtcgacctgcttggagcgcgcggcaagaatgcggtgattaagttcaatgagcttttcgacgccctccgctccgaactccccaccatggtcaatgaggtcaccggcctgccagacatcggccaagtcatcagtcgcatcctcgacatcactggctacaaggcagaacttgaggcatccaacgaccctcaagatggcgcacgcctagacaacctgaacgagcttgtctccgtggcccgcgagttctcctccgacgccgcaaaccgcatggttaatgaagttccagaaggcgaagcccaaccgggcagcttacaggcattcttggagcgagtctccctggttgccgacgccgaccaaatccccgattccgacaacggcgtagtcaccctcatgaccctgcataccgccaagggccttgaattccccatcgtgttcctcacaggctgggaagacggacagttcccacacctgcgttcccttggtgatgccaaagaacttgccgaggaacgccgcctcgcctacgtgggtatcacccgcgcccgcaagcgcctctacatgaccagagccatgctgcgtagctcctggggcaacccggtgaccaacccaccgtcacgtttcctccaagaagtgcccgcagaactcatcgattggaggcgcgaagaaccccagatgtcttccgcctgggctcctcgacccacccgaagcatccccaccaaaactcgcaccaacaataagcagttggatctgtcggtgggggatcgcgtcaatcacgacaagtacggcttgggaaccgtgctctcttcagatggcagcggcccccgagccaccgtcaccatcgatttcggttcctccggcaaggttagattgatgcttcttggtggcgtcccgatggagaagctatagccccaatcacggcgcacaccagcggcgccacaacgaggaggcttaccaacagaggccacggcagcatcatgtgttcaagcgtgccgtagttcaaaattgctccatcaacaatttcatcagtggtgcctgtcagcagcgctgcaatccatccggagacaaggcccatgatgcctccgacaagggcaagcaacgctgcatttaaggcattgactttgtagattgttccaggtgttgctccgatggcaatcaatgcgtgctgttggagtttgcgattagccagcacgatcacaagggaaacgaccacaattgccaccgcagttagtgcagcactggaagcaagtgaagaattatggccgtcgtggctgaaatgcgcatctcttgaccgattgattgcttgtacagtttggtcatctagttcttggggaagcacgattgttcccaagaattctgtttgtcctccgatttcttcaaaagtttctgggcttaataaaacatgtgagtacagcggcggtaaaacagcagcggtgtctagcatgtaggtttcatcgccggggtatattgcgtattcttgcagcccggaattataggttgatggcgcgtagatgtcggcttgttcgtggacaccgaacatgtctaaaatcttgggcgtggcaataactggtccgccaaaaaatgaggtcagtgcgggcacatagttggccgagtaaaaatctacatctagttcatagataccaaagccatggttatcaccgtatacatcgattttttgccccatgagtccagggatttgtgtgtcaccgcgtaagaatacggcctcaggatacaccgaggcggtagcttctctatcgctggcttgggttgcaagtccagttgtttgcataaatgtaccaagcataatcactgccgccagcgcaccaatcgcaggaatggagtgcattgatcggcgcagcatatcgcgcgtagctagtttgaatgtcaaaccaggcaggcgcccaagcgcccacaacaccgcaggcactgaggccggcagggcgatgacggctgccaggaagcataattgcttgacgacgcctccccactctccgtcaccgataaacaaggcgattaccgcagctgcaattaagacgattggcccgatgagcattcgagggctccaccggatgattttgtcggagattcctccgtagattccgttgatgatgcttgatctactgacaaaaactgccggtaagaatgcagcaatcgttgaagcgatgattgccagcgcccaaaaacctacaagaactagccagggggtggtgagggagaattcaggataggtgtatttccaccagccgtagatgcctatttgccccagaactaaaccaatggatgccccaacaagacctgcgaagagcccatatgtaagcactgcccaccgaatgtgtctaggtgtggcaccctgtgaggcgagcagtgcgaaagttctggtttgccttgaggcggaaattgtaaatactggtgagatcagcatgagtgcaacgacggcgagaattgtcgtcgataaaaatcccatgatgtagcttgggatcaaatttgggtcgacggatatggggccgcgccgatattcattaacttcaaagccaactgcttctagtgcttgtcggttttcttcggtgaaattcgatccggggaagtaccaggtgccggaaaaagtttctgattcggagaaattctcaagagaaaacagagtaccttcgggcaataagatatttgtgggagaaatcgactgaacttccaccggggtgccgtgaatggtcacggtatcaccgattgtggcacctaaaacatcgagtgcatcggcgggaaatgaggcttgttgtacgtttgttgattgcacaacaaagaaattgacttcctcatcaccgaaggagacttctggataaccattggcaaagagttccaggtggaagtcttctggaaggttttcttggaggagttggtaggctccttctccgtcatagtgagcttgtacctgggaaccaggatagctagctgcattgttgattgattgatcataggtaagaaagaaactcaccaggaacatcggtacggccaccaacaagatggctgccagcgatcgccatgggtgtttaaaggcatcgcgcagggtggggcgggttgctgctagaagtgtggtcactggatttcaccatccctaagcatgattgttcggtctgcccacgcggcgaagcggggttcgtgggtgacaaggaggcctgcggcaccggaatcgattctttggcggaggacgcggaggactgcgtcgccggtggaggtgtcgagggcgccggtgggttcgtcggcaagcaagatttttcgggggccgatgagggctctcgcgatggcgacgcgctgggcttggccgccggagatctcttcggggaagcggtcgtcgaagccttcgaggccgacttccgcgagtgcgattgctactgcctggcggtcggttttgccgtcgagttctaggggcagaccgacgttttctccgacggtgagggtggggaccaggttgtagttttggaaaataactccgatgtggcgacgcctggtttcagctgcgcgtttggcgttgaggtctgaggcgctggcaccgtcgataagcacatggccagaggttgcgcgctgcaggaggccggcgacgttgagcaaggtggattttcctgagccggacgggcccatgatggcaacgagttcgccgggattgactgccagcgagacgttgttgagcgcggagacgtggcgtgggccttctccgaaggcgcaggagatgttttgaagttcaagggggaaaggcgtgtttgtcatttactgctccaatgcttcaattcggtcgagccaacgtgcctgggcttctagttcaaagattcgcttttcgacgaggagccgctgggtgtttctggtttcggcgagatcgcggctggatttgttgagtgcgcgtagttccgccatgactgtgttgcgttgaatgtctaaaagtggaatcaaattgaggccacgtgattctgcgatggcgattttggtgactaattcatcgcgttcggacagtgtgacggtgacgggactttcgaaccactgcgcgacaagttcgcgacctaagtccgtgggctggaaagtatctacggtgcggccgttggaactgacggtggtgcctgcggtttccgccaggccgtcgcgctgtagccgctggatggtttgggtgacttggccgatattgagctgccagatccccattgtttcttcaaacttggtttgcagctgacttgccgaggttggttcgtcgagcatgagcaccaagagtgcatgttttatggacattgttccccaatcaagagttggatacccagtaacttactgggtatgttttgggaacgcaagaggacgaccgtaaagggtcgcccaaaagttaattaaagagtaatgccgcgctctgcaagccaaggagctggatcaacagcgccaccgcctgcagggtaaacctcgaagtggaggtgggagccggtggagaatcctcggctacccatgcctgcgatgcgctcgccagccttaacagtctgaccaacggtcacctcaacggtttccatgtggccgtacacggtgatggtgccatcttcgtgctggaggcgaacccagttaccgaaaccggaagcaggacctgcatcgataacagtgccgtccatggcagcgaggattggagtgccgattgcgttagcgatatccacaccgttgtggttggtgccccaacgagcaccgaagccggaggtgtaagaaccttcagcagggcgaaccactgaagggccacgagcgtccaggtcagcctgaatgcggtcagcgttgtactgaatggtcttaacgatctgatcgcccaagttcacaactggcttgaactcagcgatggacaggatctgaggggcggagcttccagccacgaggtcagttgtgtcgtttgcagtaagctcgaagttgacctcaacgggctgattggaagcctgtgcagcaactgctccgcctgcgcctgcagttgacacggcaccggtagctactgcaacaaaagcgacaccacccttagttactggggaggtagtctgcttgcggtgcttgccacctcgagtgtgcttctgcaatttcgcctgcttccgattcttgccacaaaacttttcgaagcttatatcacgctatcgaagtttaattgagaccatcttgttatctaccggaagtaacactagccggagattcccgatcgggcaagtgaaaagccaaagtttgattactttttagcaaattgtgcaaaaagtaatacttttctcacagtgttactctccgacgtgccatcgccaaaactatccgtattagtggcacagttgtttattgatgagcaagaaaaatagttcgcagacacgacccggtcagatccgacgtcgccggccaaaaccgcaagcacctgcgcaaacgccacagaaggcagctcagcaatcaaagttgctgcgtttccttccaaccgtgctgattccgcatggcgtggcggtgcttttggttattattctcgccgtagcctccctaatgttcaccaattcttcaatggtgaatctttcggcaacgattgcacagctgtggctttccctaaatctcggtgcggtggacggcagtggggaagtgatctcagtactgcccacgcttcccggctttatattcctctgggccatcgccgcgcgcatccaccgcgcagtcaaagatcgtgtcagcatcgccgacttaggcgtcctcgcagcactcgtcctcggcatcccgcttgcgctcaccgccatcgcagcgttcatgcttttcgacgcctccagcgtcctcaacgtcgaggtcccgccaatcacgcgcctcctacgcgtgatgttgttccacctcagcgccctcttcctcggcatggggccacgcctgtggcaggcgttggcgcgccgctacggtgctccagaatggcttatcgacgccatcacccaagctttccgcttcctcatcgcatttggaacagtctccttggtttccgtgctcgtgatgaccgcgatcaaccacagtgcattcaccgcgaccatgcagggctacgacgactccgcctctgttgtggccttgatcgtcctgagcattctgtatctgcccaacatgatgatctttgcgatgggcaatctgatcggctcacccctttacttcggtgacgcctccatcagcgtcttcagcgtgcattccgttccattgccaccgcttcccatcctcgcagctctccccagcgaagccctctcatgggcagtggccttactggtcatccctgcaattattgccacctgggtctgcgtgagaaaccccatgcgccttgccgtgaacacaacagcagcagtcatttcagcactgtgtttcctcgtcctggcagttttcgccggcggaaccttgggcgtatacaactacgtcggactcaacctcctggcgtcagttggcctagttttcgtctatttcgccctcgttggactcctcatcgccggaatcgacaagctgcgcaaccctgtagaagttaagtctgttaaggctgtggctgttgtggagcccgagcctgaagaagttgaagaggacgaagaggagcatgttgaagaagaagtagatgaggaggaagaggaagttgaggaaggggtagaagaggtcgaagaagacgacgcagaggatcctgaagagaatcctgaagaggaagaatccgacgaagaaattgagacagaaactgaggctgaagaaaccaatgatggttccgaggccgaagaccgttaacatatctgttgtgaattctgactctacgaccaccattgtcgtgctagcttccggaacaggcaccctccttcagtcactcattgaagcgcaaggtacctattcgatcgtgggcgttgtctctgacgtcgaatgccctgcactttccagagccgcagatgcaggtattgatactgcagttgttccgcttggaaaagatcgtgcacagtggaaccacgagcttgcagacgcagttgcagtaagcgacccagatttggtggtctctgcgggattcatgaaaattttgggcgaaggtttcctctcaaggttcccgtcccgcatcatcaacacccacccagctttattgccttctttccctggtgcccacgcggttcgcgatgctttggcatacggtgtgaaagtgtcaggttcgacagttcaccttgtcgatgctggtgtggataccggcccaattattgctcaacgagcagtgccggtagaagtgaatgatgatgaatccagcctgcatgaaagaatcaagcaggttgagcgtaaactcattgtagaagtcctgaacagcgtggaattttcgcgtcagggtggcgtacaactcaactggagaggctaaatccttcatgagcgatgatcgtaaggcaattaaacgcgcactaattagcgtgtatgacaagactggcctggaggatctagcccaggcacttcaccgcgagaacgtggaaattgtttccaccggatccactgcggcgaagattgctgagcttggtattcctgttaccccggttgaggagctcaccggtttccctgagtgccttgagggccgtgtgaagacactgcaccctaaggttcacgctggcatcttggcggacacccgcaaggaagaccacctgcgtcagctcaaggaacttgaggtcgccccattccagcttgtcgtggtgaacctgtacccatttgctgagaccgttgcgtccggcgccgatttcgatgcttgcgttgagcagatcgacatcggaggcccatccatggttcgtgctgcggcaaagaaccacccatctgtcgctgtggttgtttcaccgaaccgctacgaggatgtccaggaagctttgaagaccggtggattctcccgcgcggagcgcaccaagttggctgctgaggctttccgccacaccgcaacctacgatgtcaccgttgcaacctggatgagcgagcagctggctgccgaagattctgagactgagttcccaggttggatcggcaccaccaacaccttgtcccgcagcttgcgttacggtgagaaccctcaccagtctgcagctttgtacgtgggcaacacccgcggacttgcacaggctaagcagttccacggcaaggaaatgagctacaacaactacaccgattctgatgctgcatggcgtgcagcgtgggatcacgagcgtccttgtgtagctatcatcaagcatgcaaacccttgtggcattgctgtttctgatgagtccatcgcagcggcacaccgcgaggcacacgcatgtgactctgtgtccgcattcggtggcgtcatcgcgtccaaccgtgaagtcagcgttgagatggctaaccaggttgcagagatcttcactgaggtcatcatcgctccttcctatgaagagggcgctgtggagatcctgagccagaagaagaacatccgtattcttcaggctgaagcacctgtgcgtaagggctttgagtcccgtgagatctccggcggtctgcttgttcaggaacgcgacttgatccacgctgagggcgacaactccgcaaactggactcttgctgccggctctgctgtttctcctgaggttctgaaggacctggagttcgcgtggactgcagttcgttccgtgaagtccaacgcaattctgttggctaagaacggcgctaccgttggcgttggcatgggacaggtcaaccgcgttgactctgctcgcttggctgtcgaccgtgcaggtgcagagcgcgctaccggttccgttgctgcttccgatgcgttcttcccattcgctgacggctttgaggttctcgctgaggctggcatcactgctgttgtgcagcctggtggatccattcgcgacaacgaggtcattgaggcagccaacaaggctggcgtgaccatgtacctgactggtgcgcgacacttcgctcactaaagtttttaaagatttcgcttgaaggcagaccataaggtctgccttttcgcgtattaatgagtacatgtctgaacttatttgtggaccagctattctcttcgcaccagctggacgtgctgagatcattccaaaagcagcatcgaaggccgatatggtcatcattgatttggaagatggggcaggggaggtagaccgtgaggtcgcctacaggaacattagagaatcggggttggatcctaaacgaaccattgtgagaaccgtagggccgagcgatccacactttttggctgacgtggagatggtgaagtccacggatttcacacttgttatggttcctaaacttcttggcagcgtgcctgaggaattagatggcctcaacattatcgccatgattgaaacccctcaggctgcaaccagcattcctcagattgctgcggaccctaaagtcgttggaatgttctggggcgcggaggatctcacacacctcttgggaggcactcattctaggttcttgggtgatgagtccaatgaaggctcctaccgagacaccatgaggcttacacgcgccctgatgcacctccacgcggcggcgaatgggaagttcaccattgatgccatccatgcggatttccacgatgaagagggcctctatttagaagcggtcgatgctgcgcggactggtttcgctggcaccgcatgcattcaccccaagcagatcgagattgttcggagagcctatcggccagaggctaaccagttggagtgggcgaagaaagtggtggaggaagcagaaaaccatccaggtgcgttcaaactggatggtcagatgattgatgctccgttgatttcgcaggcgcggatggttatttcgcgtcagcctgcttgattagttcaagcgttttttcgacccggtcggcgggcagcggcgcgccgaggacggcgagggaggcgtcggcaagcataattgcggtctccgggaggctgtctgcggaaagcgggcttggaatcttgccgtcgttgcgacgcatttcgatcaccgacatggtgatgtggaaggggagttctgcgcgggggtcgtcaccgacgatttcggtggcgaggtcgcggaagacgttggtgagggcttcgcgctggctgtggtactcggcgaactcttcagaaccaacgatggggagttggtacaggcgaccgacgttccacttggtggacagcagcagacgcacttcggaggcaacgattgcccagaggcgcatctcaggtccggcgtccagggtgcttaagtcttcggcgagcacagtggacggctcgacagtagatttcagcagggtgaggaagatttccgtcttggacgggaagtgataatacagcgaggcttggcggattcccacggcatcagcgatttgatgcgtggaggttgttgcgaagccttgacgggtgaaaagctcagcagaggcgtcaagaatctcctcgcgaggattcttgcctgcccgtcgcggagctgatctccgggggcgtcccactgctcctgccatagcgtaattctacttccttaaagttttggcctattgatctcaagagattgtagccagtaattgtgcagagttcctatttggtatcgatttcacgggcttcaacggaccgcaacacctcagaaagcaaccgagccgatgcgccaaaagtggcacgttgcagcgcgggaagctcccaagcggtggtttcttgatcatggatgtgatccatccaacgtttcgactgcaagctcagtgcggaagtccacacctgtgtcagcgcgtcgacttcatcattggtgagcacaccacgggcatccacgaggcgctgcgcagtcgtaggcgccaaagaaccagccttgtgtgctgcccagcgagcgatcttcaccgtgggaatcatgaggttctcacgaatgtttaccaccatgtccaacgaaggaagaccctcataagtttccaccgcaggcggcctagatgacaacgcatcctgcaacagtgctttgtcatctacttcagcgatcgccgcgacccacgtgccagcatccaaatagacctctggatcctcaccagcgcgcgcacgctgctcccactcctcacgagttgccgcaccgatcggctccgcaatgaagcccacctcagttaacagcgctgaaatcttttcattcggatcttcttggctatcgacgaccgccagccacctcacgggcgaggtaggcagtgcgtctccacgccccacggggccggtgagcaccacgtgggcatccaagccaggggagtgcaaaacatcagtaataacttgtgacagccaccctgcaagctccgcgggctcttcaccgtggttcagtgcattgcccaacaaatccagcgattccttcagcacaccgcggacggtggcaaaatcctgtgcaagtggggcagcatccgctagctcagtcaatgaggggtgaagcacgagtgattccttccagttctctagtagttctaaaactacactgcgcatgcgacaccaatagaatcagacatagaattaggcatagaattaggcatagaaaaaaccacccgcactcgaaatgagtggggtggttctttgagaagtcgctgttacgttattcccagtcttagcggctggtgaacggcaggagagccatttcgcgtgcgttcttcacggcggttgcaacctcgcgctgctgctgcggggtcagaccggtgacacgacgtgaacggatcttgtggcggtcggagatgaactgacgaagggtgttgatgtccttgtagtccaccttctcgatgcccgctgccttcagcgggttcttctttgggcggcgagtctgctcaaggcggacgcgcttagcgttgttacgctgcttcattggtaaaaactcccttaccagctggacttacgaacgcccggcagctcaccacggtgagccatctcgcgcatacggacacgggaaagaccgaacttacggaggtagccgcgtgggcgaccatcgtgtgagtcgcggttacgaacgcggacagcagcagcatcacgtggctggctgttcagttcgaactgtgcatccagacgatcctcgtcagaggtgtttgggttactgataattgccttgagctcagcgcgacgctccgcgtagcgggcgacgatttccttgcgcttctcgttcttggcgatctttgacttcttagccattgattatcgctcctcgcggaattcgacgtgcttacggactactggatcgtacttcatgagggaaatacggtccgggttgttgcgcttgttcttacgggtgacataggtgtaaccagtgccagcagtagacttcagcttgatgatagggcggatatcattacgtgccatctttagatcttctccccacgtgcgcgaatctgagcaacaacggcttcgatgccgtcgcggtcaatgaccttcagacccttggtggaaacggtcagagtgatggtgcgtccctcggaagggacatagaacttgcgacgctgcacgttggggttccaacggcgggaagtgcgtcggtgcgagtgtgagacagacttgccgaaactcggcttgcgtcccgttacctggcaatgtgccgacataacttactttctcctagccgcccacattcagttagaagacgcgccgcaccgggtgaccggggcgcgagcatgccagctgacggggcgataacgaatatttacgacaacagcaagggacaagtttacatacgttgccccaaaacacctaatcgcctattcaatgcgggtttagatcgccccggaagccttaactgttgtcgatcttaacgtgttttcgggcatgttcaaccgctggggcaaggtcatcgaagaggtggttctcatgccgcagtgatctgatcgctccgaggacgccgagaacgtgaatgtgttctttccggacgcccttaattaatacagtgacattttttctttccagcgcattgacaagctcggtgagctggtgggcgccggtggcgtcgatcatttggatgtgtgacaggcgcaggatcaccacttcgaggtcctcataatcaaggatttgctgcgaaagacgttcagctgcgccaaagaacaatgcgccctcgatacggaaaaggccgatcttttcgtcgttaagcgtggccggttcgggcaaggtttcccggaagacgccggcgttcatgctcatgcgtcgcagcatgaagaacgtcgcgacggcaatgccgatgccgaccgcaatgacgaggtcgacgctgatggtgacgatcgcggtgatgacaaaaacgatcgcatcagagcgagtggagcgcatgacgcgcgagatcacttcaatggacaccatgcggctcgcggtgaccatgagcacgcccgacagtgcggcgagcggaatgaccgcaacgatattcgccgccacatacacaacgccgagcagcacaagcgcgtgaataatcgacgctatacgggtacgcccgccggagcgcacattgaccgccgtacgcgcgattgcgccagttgccggcatgccgccaaaaaagccagcgcttatcgacgccaacccctgaccgaccaattcgcggtcagcattataaggacccgtatcggccatggaggctgccacacgagcggaaaggagagactcaatagcagcgagcgcggcgacagcaaaagctggccccagcaaactcgtgaacatctccaggttcacatcaggcaggtgaggggcaggaagggaattggggagctcaccgatcaactcaacgggaagcttgagcagagccacgccaatggacaccaccaaaatggcaatgaagctggcagggagctttggggcgatctttcccaacacaatcatgatcgcagcggtgacgataataattaagagaggtagaattgcgtccttcgtggcgtgtgaaacagtgtgaatcgcagcgaggagcgcattggtgggcaaatggcccgaataaccaaacgcagctggcacctgttgcaggaaaataatcacaccgatgcctgccgtaaatccttcgatgaccggccacggaatgaaactcaccgttcggcctaatcgaagcactccggcgacaaggacgataactccagccatcaggctgagtaatgcaaccgcaccgacaccatattgggcgacgattggagcgagaacaaccaccatcgctcctgttggtcctgaaacctgcacattggaaccgccgaagattgctgcaaccaggccagcaataatcgcagtcactaatcctgcctcggctccgactccagaactcacaccaaaggcgagagcgagggggagggcaacaatgcccacggtgacgccagcagcaatgtccatcttccaggagaagcggagtagctgatagtcgtctctagagggtaaaaggtcacgcatcttcgccagccatcctctttaatagtgagcggctcaccttaagaaagtctgcgacctccgggtaggtgagccggtaataaacaactaagccttcgcgttgggaggaaaccagtccaaatttccttaaaaccttaaggtgctgggacacgtgagaggcttccaaatccatctctttggttatctgaccgactgaaacttcattattcgtggcaatgatttccagggctctgatgcggtatggatgtgccaaacccttgaaaaggtcagctttgcgctgataaatcggcaagtccttggaactcaacattattcctccgtgactaggctagatgacggatccatcatataactcgcgggagattttggcctgggctagacatattccataatcaatttttagttacagcgcaacaggtgtaaggtattggaggttcattgccaaatcatggtgatgcatacttaccgaacccaactcgggcacgatctggcatccgctggaaccgacctgaagtttcaatcctgagggaatcgagagtaaatgaaaaaggatatccaccctgactaccatgcggtagtcttccaggacgcaggtactggcttccagttcctgaccaagtccaccgcttccagcgaccgcaccgtgtcctgggaagatggtaacgagtacccactgatcgtcgttgacgtcaccagcgagtctcacccattctggaccggcgctcagcgtgtcatggacaccgctggtcgtgttgagaagttcgagcgtcgcttcggtggcatggctcgccgcaagaagaaggcataggagggaaaacaatggcagttccaaagcgccgtatgtcccgcgcaaacacccgcatgcgccgttcccagtggaaggccgacaatgtcgcccttcaggaggtcaagatcgacggtcagaccgttcgcatcccacgccgtctggttaaggcagcacagctcggtctcgtggacgtagagcagttctaaaccttaaattcatcgcctacaaccttttgtaggtaagaatttaacaagagccagttatcttctcttaaaatgaggaggtaactggcttctttatgcttaagaggtgttagcataagtgaaatatgttccaacgcgtggacgtcttaattgggaggaagtctgtcacggactggaagacgaaaagggtatcgatgaaaattttagttgttgatgacgagcaagctgtacgtgactccttgcgacgttccctttcgttcaacggatacaacgttgttctcgcagaagacggcatccaagcactagagatgattgacaaggaacagcctgctttggtgatcctcgatgtcatgatgcctggtatggacggacttgaggtctgtcgccaccttcgcagcgaaggcgatgatcggccaattcttattcttactgcccgcgataatgtttctgatcgtgttggtggcctcgatgcaggcgcagatgactatttggctaaaccatttgctcttgaagagctgttggcgcgcgtccgttcactggtgcgtcgctctgcagtggaatcaaatcagagttccagcattgaacaggctctattatcttgtggcgatttgacgcttgacccagaaagtcgagatgtctaccgcaacggacgcgccatcagccttactcgaacagagttcgcgctcctgcaattgctcctcaaaaaccaaaggaaagtgctcactcgcgcccagattttggaagaggtatggggctgcgatttccccacttcaggcaatgccctcgaggtctacattggataccttcgacgcaagactgaattggaaggagaagaccgcctgatccatacagtacgaggagtcggatacgtcctgcgagagaccgctccgtgacattaaggcgaatcggcgcaggggaaaatgggcctgcccctaccgaaagtgatgactccgacggttcaatgtcgttgcgttggcgcttggctttgctgagcgccactttggtagctttcgccgttggtgttattactgttgctgcatattggtctgtctccagctatgtcaccaactcaatcgatcgtgatctggaaaaacaagcggatgcaatgcttggacgagccagtgaagcgggattctatgcaaccgcagaaaccgaaattgctctgttaggtgaatatgccagtgacactcgaatcgccttaatcccacctgggtgggaatacgtcatcggtgaatccatatcactgcctgattcagatttccttaagagtaaagaagcggggaaacagatcctcgtaacaagtgctgagcgcattctcatgaaacgagatagctcgggcacagtggtggtttttgctaaagatatggtggataccgatcggcagctcacggtgcttggcgtcattctcttgatcattggcggcagtggtgttttggcgtcgattctgcttggtttcatcattgcgaaggaggggctgaaaccactgtcaaagctgcagcgtgccgtcgaagagatcgaacgaactgatgagcttcgtgcgattcccgtggtgggaaatgatgagttcgctaagttgactcgtagtttcaatgacatgctcaaggcactgcgggagtctcgtacccggcaatctcagttggtggcagatgcaggacacgagctgaaaactccactgacctcaatgcggacaaatattgaattgctgttgatggcaaccaacagtggaggatcgggaatccccaaggaagaattggatggccttcagcgtgatgtattggcgcagatgaccgaaatgtctgatttgattggtgatcttgttgatcttgcgcgtgaagaaaccgccgaaacgtcaagcattgtagatctcaaccaagtgttggaaattgcgcttgaccgaatggaaagccgtcgcatgacggtgcggatagatgtttccgagactgtggattggaaactgctgggcgatgatttttccttaaccagggcattagtaaatgttttggataatgccattaaatggtcgcctgagaatggcattgttcgagtgtcgatgtcacagatcgacaaagcaacggtccgcattgttattgatgattcagggcctggaattgctgaaaaagaacgaggattagttttggaacggttctatcgcgccgtcagctcccgttccatgccgggatcgggattaggtcttgccatcgtgaatcaggttgtgaatcggcatggtggccaactcgttgtgggtgaatcagatgatggcggaacgagaatcactattgatttgccaggggaacccattcgcagcgggttcgaaaatgtcgatgattaaaccactaaagagctcacaggaagtgttcagactacttagagtgacgccccagccacagggttcataatcaaatcatgacaaatcaattccccacaaacaacggtgagaacccggaccgtgcatcggaaactccatcagaaaccaactccttcgaacatgtgcgtagttcatatccgcagtggggtaacactgcttccaatcaaaacccctatcctggtgcgggcttcggctctgaacaaaacactcaacaaggaaatgagcaacaagctccagcctggaccagttgggataatcagcctctaagcacagatgtaaagccagctaaagaaaagcgaaaagttggcatcggaacggcactcgcgttaatgcttgttggttctattgctaccggtagcgttgtgggtgttgcagcaacccagcttggttcggactcttcaaccccagttaatgctcttgagcagcccagcgtgcagcgcaccactaatgctgaaccaggttcagcggaacaggttgctgccgcagttttgccttctgtcgtctctattcaggccattactaggacgtctgcttctgagggctctggatccattatttcctctgatggttacgtcatgaccaataatcacgtcgtggcaggcattgaacaatctggtgtgttagaagtaagtttctccgatggaactacagcgcaagctgattttattgctggtgatccttccacagatattgctgtgatcaagattagggatgtgtccaaccttccagttatgagctttggagattcggacgcattaggcgttggacaaagtgtgatggctgttggttctccactgggtctgagctccactgtgaccaccggtattgtgtcggccgtgaaccgtcctgtgcgagcttctggtgatggcggagagtcgtccctcatcgatgctatccagaccgatgctgcgatcaaccctggtaactctggtggtccgctggttgatatggatggcaacctcattggcatgaattcggtaattgcatcgatttcgagcaccagcgattccgcaggttccattggtcttggtttttctatcccatccaactttgccaagcgcgtggccgatcaattgatcagcaccggccaggtaactcagccgatgatcggtgtgcaggttggcactgacaactcagtgacaggcgctgtgattgccagtgttcaagatggtggaccggccgcagatgctggacttcagccaggcgatatcgtgaccaagctcaatgatcgagttattgatagcccagactccttgatcgctgctgttcgttcgcatgattttggcgaaaccgtcactttaacaattacacagccagatacctcgcagagccgggaggtagaggttactctgacgagtgagtaggtttaaaagagttaatctgcatctaatcaagtagccaagtatgagtgaggaacaatgagcaaggatccattgggaagtcttaccgatgttgtagacacacgagttccgcttccggatgttgaaccggatccggagttcctgaaggctacggaaaaagaattccacatggcatcccagaagcgcgctcttgttgtcctggtgggcgatcatgtcgctgaggcagatgggactggccgtttggttacggagctgctcttagagtctggcttcaacgtggacgctgtggtcagcgtgaagtctaagaagtctcagattaggcaagctattgaaaccgcagttgttggcggcgctgaccttgtgctgaccatcggcggagtgggcgttggtcctcgggataaaactcctgaggcaaccagcgctgtgttggaccaggacgtcccaggaatcgcgcaggcgcttcgttcctccggtttggcctgtggcgcggtggatgcaagtgtttcccgaggcgtagcgggcgtatccggctcaaccgtggtggtcaacctcgctgagtctcgttcggcaattcgtgatggcatggcaactctgacaccgttggttgattttgttgtagatcagcttcgcacttccgtggtttgagttggtcgggtgtgagtagacaacgtagacgagcgttccgtgcgtcagatgcaaaggactatgatcgcacggcagattctcctctggaatcaacaactaacgatgatgtccgggaagtttctttagatccagaacaagatgaccaaccaacaggtgaggaattctggaaagaacagcaaccaccgcatcatggttagcagcataatttaggcaacaaaaagtgcgtctgagtgaaatactcagacgcacttttgtgcttttagggccttttaactactgaaggcgcttttgctcctgcaggagatcgcggatctcggtgaggagttctgcttcgatggaagctggggtctcgtcttcttcaacacccttgcgctttgcgagggtttcgctgagcttgttcattggagcaacgaggacgaagtagacaattgctgcgatgatgaggaagttgatcgctgcggtgatgacagcaccaaaatccacgaatgttgcggcattgccggcgcggatgtggaagccgaggccttcaacctctgtgctgccgatggaagcgatcaatgggttgatgatgctctcggagaatgctgtcacgatagcggtgaaggcagtaccgatgaccacggcaactgcgagttcaatgacatttccgcgaaggacgaaatctctaaaacctttaagcatggttgttacccctgacgatagtgtggacagtaagaacgacaaatgaactgtagcggaaagtaccttttttttgaatagggaactattcttcggttgtgtaattatctgctctgtctccggtcaggactaccgccagaggggtattgagcgattgtgctgcaaccttttcagcgattgattgtggaagcgcaatcaagatggttgaggggtctgtaccacccgccagaattactgttccacctgcagcaatgttctctgggagaccggtgtctgggtcttgggaaacaaccgaaatggtgtccccatgctgcagtagggggatgacggaaggttcagccaaactgagtggaaccatgttaatttcttccaccaaagagctatcagtgacgtttgtcgcaatggagtttatcaattcggtgcccacgaatcgaggctttgtggctatttccccggaacttaatgtggaggccgcaacgagcccaactacatcgtcaatcgaatcgtaggaggtgctgggcagtagggaagtagggattgcctgaagtccaaggtcagaggcctcaaccttggtgccagcaggaatttcttgcactatgacaacggcagttggatccttcttgagccaagaatgtgccatcagcagtcctgcaatcccgatcaggatgaaggcgattattcttcttaaaactagggtgcggtgccaactcggggtggtgaatgtcttttttaagtccatatagtggttggactgttttttaggctcctaggttccgaacacctgcgggggtaattatgacgttgacgggaagatcatgttcttccacttcgatatcgtcgcggatttctccgttgaagagcaaagtaatcacgtcagccttgactccggtggctagagcgcggtcgtagaaaccgccacctttacctagcctgattccactgggggtgcatgccagtgcgggggcgatgacaaggtcgcagaagttgagagcttcaggtccaaggcgagtgccaccgggttcctggatgccaaatgcgccaggaacaaggctggttgggccttcataaagagcccagtcgaggcgtcgatcctcgagggagactggcaaaataagcgcggaagtttcggcgtggagggcgtcgagaagcaatcgcccaccaggttcggtacgcaccggcacgtaagcggcaatcctttttggctgctttgagcggatgtaataagaaacgttggcaatgatggctgcgttttctcgcgtgcgagaagcctcatccatattggtgcgcgcttcccgaagcttcgtgcgcagttcctgcttagtttggctcataaatctaaggataaccgttattttcggaggggtacgacgattggggttgcgggggcaggtactcttggttccatgagtttgcctatcgatgagcacgtgaacgcggttaaaaccgtcgtagtgcctgctgcaggactgggaacccgattccttccggccaccaaaaccgtacccaaggagttgctgccggttgtcgataccccaggtattgagctgattgctgctgaggctgccgaacttggtgcgaccaggctggcgatcatcactgcgccaaacaaagctggggtacttgcacactttgagcgttcttctgaattggaagaaacgctgatggagcgtggcaagactgaccaggtggagataatccgccgcgccgccgatttaatcaaggcagttccagtaacccaggacaagccgctggggctaggtcatgctgttggtttggctgagtctgtgttggatgatgatgaagatgtcgtagcggtgatgttgccggacgatctcgtgttgccaaccggtgttatggagcgcatggctcaggtccgagcagagttcggtggatctgtcctttgtgcagttgaggtttctgaagctgacgtttctaagtatggcatctttgaaatcgaagctgacaccaaagattccgatgtcaaaaaggtcaagggcatggtggaaaaaccagccatcgaagacgcgccatcacgcctcgccgcgactggccgctacctgcttgaccgaaaaatctttgacgccctgcgccgcatcacaccaggcgctggcggcgagttgcagctcaccgacgcgattgatttgcttatcgacgaaggccatccggtccatatcgtcattcaccagggcaaacgccacgatcttggcaaccctggcgggtacattccggcgtgtgttgatttcggtctgtcccaccctgtttatggtgcgcagctaaaagatgcaatcaaacagattttggctgaacatgaagctgcggaacgtattgcagacgattctcaagtaaaatagctgcctggttccgattaggaggtccgtagtgcgatcagtcgagcaacagctatccattgtcaccgaggcagcggtagctccagagccagtgcgtattgctattgcagaggcactgggtttgatgtgcgcggaagaggttcaagctagtcgtgctttgccgggtttcgcgcaagcagcgattgatggttatgcggttcgagcagtcgatgtcggcggcgagaagtcgcttagccagcaactgccggttgctcctccggaaaaatccctgcccgtggtgggtgaagtagctgcgggttctcagcagccgttgcgcctgcagcctaaacaagcagtcatggtccacaccggtgcgccactgccgatgcttgcggatgcggtgctgcccatggcgtggtcagatcgtggccgcaaacgagtaaccgcgcagcgacctgtgcgctctggcgagtttgtgcgcaaagaaggcgatgacatccaaccgggagacatcgcagtcagcgccggcgcggtcttaggccctgcccaaattggtttgctcgcagctgttggtcgctccaaagtgttggtgtacccacgcccacgcatgtcggttatctccgtaggcgctgaacttgttgatattgatcgccagccaggcctcggccaggtttatgatgtcaattcctattctctggctgccgccggtagggaagcgggcgcagatgtgtaccgctacggcattgctgccggtgaacctcgtcgcatcaaagagatcattgaatcccagatgctgcgctcggaaatcatcgtcatcaccggagctgttggcggtgctggttcagctggcgtgcgccaggttctcaacgagctaggcgatatcgacaccgaacgcgtcgcaatgcaccccggttctgtccaaggattcggtctgctcggcgagaacaagattccatgcttccttctgccttccaatccggtggcgtcgttagttatttttgaaaccttcgtccgcccggtcgtgcgcatgagcctgggcaagagcaatgcggcgcgccgggttgttcgagctcgagcgctcaaccacgttgtgtctgtggcgggtcgaaaaggtttcatcaggtccaggctcatgcgcgatgcagaaacccaggactacctcgtggaggctttgggtggtgcaacgggcgcaccatcgcacctattggcaggattgtccgaagcaaacggtatgatccgcattccagaagatgtcacagaaatccgaccgggagatgtcgtggacgtgatcttccttgcccaaggtcgatagttcgatgcgtaatgcaccgtcaggtccgacgcattttcgacaccccggctggccagagtcaacgcaaacggtcattttgccggatggcggcaggctacgtttgaggcccttgaagcgccgtgatttccgcgcatggtcggatttacgcatgcgcgataaggaattcctcaagcccgtggagcccacggttcccacgtcctggagtgaagcgcattcgcggttgtcctggtgggataacatcacctatttgatgcgcgctgcgcgaaaaggcaccgtggttcccatggtcatcgagttggatggccggttcgtggggcagttgactatcggcaacatccagcacggcggcatctccgatgcctggattggctattgggtttccagcgcggtgacggggcgcggtatcgctacggccgcctgcgcgctcggcgtggatcatgcttttcgacgcataggtctgcatcgcctcaccgccacctatctacccagcaacccagcatccgggaaggtgctcggacacagcggtttccgcccagaaggctatctcattagaaatctgcatattgatggacaatggatggatcaccattttgtggcattgctggcggatgagtattcaataaccgcggtggaacgtctcactagagagggacgattgcgccgatgattactaatgcgaagaaatttttcggcgtggcacccaagaggggtgtgagattgccgataccctcaagttcagatttaaattttgcacccgtacgggaaggttaggtgctccacgtgtccggaatccttgtgatcggcctgattgtggtggtgtggcttgttgtgctcgcaccgctacttcttcgaggccaaaagcccattgctaaggctggagaagcattcgacgacacccgcgttatctctgaaggcggaagcaacattccgtctcctcgtcgccctggcttgagttctgctcagctagacgatgaggaagatacagatgatgtggatgatgattatgagatcgtcgattctcccagcattttccgaccacgcaaagaggaacccgtcgaggaagatctcgacaccgatgtagagcttgaagaagacatcgaagtttctctagaaactgatgactacgttgagcctgctcccgtcgtagaagtttcacaagagtggaatgtggaagatcattacgagctagatgattcctacgacaccccgcttgatcacttgcacccagctgcaagggctcgtgcatatgaggacttccaggaacaccagcctgagcagcagcctgaggtcgaagaatttgatgcagacgatgagctgactgaagaagatgttgcctttgcacagcgtcgacgtggccgtggctactacgacccagaggctgaccgtgagttcgctgcctcccagtatgttcgccgccagcgcaccctgttgggtcttgcagccacagtcgttatctctgtaattctcggattcgtctttggcggttgggtctggggactgccagcagtagcattggctgcgaccgcattgtacctgatggctctgcgcagtcaggttcgtgaggagaatgctcttcgcgctcgtcgaatccgcaggctccgccgctcccggatgggtgtacgaaactctgaagaccttccttcccgtttgcgtcgtccaggtgcagttgtcctcgagcttgatgatgaatcgccagatttcgaaggcctcccaacggtggcaatgccggaggaaccttactacgaggagccacgtcgaaacattcgacacctgggtcagcgtcgcgtgagctagccacagggtaaggtttcggactatgtccggaacctccccaaaactaaaagtctttacctttctagctgtcctcgtggcagcttttaatttgcgctcagccatcgtgtcggtcggcgcagtgcttgatgatctcgtccatgattttggggcgtccggatcaaccgcaggaattatcacagccataccaggaatcgccttcggcatttttggtgtggctgctgtgcctttagcgaagaaaatcggactcagtggtgcacttacatccggaatgatcgttggactcatcgggttgtcaatccgcccatgggtcggcaacatttgggcatttatcttcctcaccggcttcgtggtgatgggaattgcggtcgccaacattttgcttccggcgtggatcaaactccacggtggcaaaagcactgtcgcattgatgacggtgtacaccaccgtgcttggtgttggatctaccttggggccgttgtccacattgctgtttagcggatcgaatgcgtggcgctgggcaatctttatttgggcacttcctgccgttttgcaggtggcaatctggctgcccatgtggtgggacaagaagtatgacttcccagccgagactgtgaaatctggttcgactggaaagatctggacatcgccaacagcattcttcatcatgctgttcttcggtttgcagtccatgaacgcatatatccaaatgggatggctgcccaaaatctttatcgatgcaggtgtaagtcccgcacatgcctctatcggattgtcgattgtgggcatcatgggcattgttggtggattcaccatgcctgtcgcaatcgctaggaccagggataagaacctcgtgtggttccccgtggtctttggtgcatcgatgttcctcggttatgtgggaacgtggctgtggccgtcccaaggctggtacctgtggtcattccttcttggtttaggtggactctgcttcccgatggctatcgccctgattccagcgcgtacgaaagatccgagaattaccgcaagcttgtctggatttgtgcagccggtgggttacattcttgcagcccttgggccattggcagtgggagcgatctaccaggcgattggctcctggtcagagatcctcgttggtttggccttgggcacagtagtgttgtcgattgtgggattcagagcagcacgcaatgtgacggttgatgatgaattgaggagatcaaagtagcctcaactaagcgtcacgataagaacgaggggcaaggctgatgtactctgtcaaccatggataaaccggtcgtgagggatgcagctctgctgatttttcgcgctgtgctcggagtgatctttgtggcacacgggtgggaaaagctgttcatctccggagttaccaagacaacaggacaattttcagcctggggagtgcctcaacccaagctctcggtgtggatcacatcgatctctgagctgctcggtggtgccttcctagtggttggtttgctcaccacctttgttgctggtgcattagcgctgttgatcgccgctgctatttactttgtgcacttgagttcgggctttttcacagttgagaacggcatcgaattccccttgctcatcattgtttctttgctcgtgatcgttgtgtttggttctggtagagccagcgttgatggggtgctcacgcgtggttgactgtagtgccattcaagccgcgctgtccgccaaattagatggtgagccgacaggcttggatgatgcagtaattgaagcgcacctcgctaattgtgaagagtgcagaaattactacaaccgtgctgctgagttgaatcggatgctcaatttttgcgccgcggaacctcgcaccctgaccccgcctgatctatcagagatcattctggcagaggtggaaccagaatggcgcaggcatgccaacgccaaggttgtgggatccctgctatcgcgggtgttgttggtgatcctgggtgtggtttacctcgcctggggtatcacaatgttgggggattcggcgtcgataagcgtccaagaagacccgctcacctcgcgcctgctcgcggaggccgttgcctaccgcattgctctttctgtggggctgttatttgcggcgtggaagccgcggattatcgcgggcatgctcccgatttttggaacgttgtggacatttagtgctggttttgctgcgcgcgatctcgtgtttggcgtcgccgattcacagacgggactgtccattggtctgctgttgatttctacgattgtgctgtcgtttgcgttggtgaatagttctggaccgggtattttgcggcgcacatggaactcattgaacgccgcgcccggctaaggtgggaggcatgagttttgctgaacatgcgatcatctggcacgtctaccccctgggcgctttgggtgctcccatccggcctgaagcccccgcacctgtcacacatcggctccccaatctaattgggtggctggattatgttgtcgaactaggctgcaacgccctcatgctgggaccggtattcgagtccgtcagccacggctacgacaccctcgatttctaccgcatcgacccgcgcctcggcaccgaggaagacatggacgcgctgctggaggctgcgaatcagcggggcattggagtgcttttcgacggcgtcttcaatcatgtttccagttcctctaaatatctcgacctgaccaccggggcgtcatttgaaggccacgacatcctggcggaactcgaccacacgaatcccgccgtagtggatctggttgtcgatgtcatgaaccactggctcgaccgcggaatcgcaggctggcgactcgacgctgtctacgccatcgcccctgaattttgggaaaaagtcctgccagaagtgcgacgaaaacacccacacgcatggatcgtgggggagatgatccatggagattactccgactacgtgaaaagctccggcattgattccgttaccgaatacgaactgtggaaagccatttggagcagcatcaaagagcgcaatttctttgaactcgaatggactttgagtcgccacaatgaattcctcgatactttcgtaccgcagacattcattggtaaccatgacgtcacccgcattgccacccgaatcggtcaatcaaatgcgatcctggccgcagcgatcctcttcacggtcggaggaaccccaagcatttactacggcgatgagcagggctttacgggattgaaagaggataacgttttcggtgacgatgccattaggccacctcttcctgccgagttttctccactgggcacctggattgaaaacatttataaggctctgatcgcgctgcgcaggcaacacccgtggttgtatcaggcgcacaccgaagtccttgagattgctaatgaagcgatgacctataagtccgtcggtcttggaggtgaagagctgacagtgcatcttgatttggaagaggtgtctgttcggatccttgatggcgagaaggtgctgtttcagtacagcgcttagttgtcggttcaagggtaggggaacaaaattgcgaaaatacaccacaaatcacttgataatggtgacgtgtggtgtatttttgcgcttctggttcgattcgatgcaaaaatctgttcgattttaaggtctggccacaggtttgtggtgagttcttgatcagcaagctcgcaggaatcacacctgacccactggcctcaaaatgaggggctcccagaatcgcttgtaagcgcccaaatacgctcgacccatgcccaaacctgctttgaggaagtccaaccccttaaatcgccttctccagtcaaggcgcatgccaaaccaggtgaccgaaaaacctccggccgatcaatttcggccatatgggacggttatccgctctcaaaaccaaaccaggtgaccagtcgctctaggaaatgagctgcgtcggtcacctggtgcggtaaaaggggaggttagcgccagcttgggaaccacatcaaggattcgtagacataatctgggatgacaaatccgtaaaacagtggcgaaaacgcgagaaacatcatcaccacgagggaaatgtaggtgaccactgccattgatccgcgggttaagccagtgggggtcatttttccacggccccacagttcaccgcaggcgagtgccaacatgatgatggtgaatggaactagggcggtggcgtagaagaagtacatttggcggtcgtatgctgcaagccacggtaaaaatcctgcggcgaaagcaaccagcgggacaacatagccacgactccgacgtgcgaagaaagaccacagcgcccacagaatgactgggactgtcagccaccaaatggcgggcgtgccgaagaggtagatcatgcgtcggcaggtgccgccaacgtcgcaggagatgtcggtggaggagaagtagaggatgggtcgaccggagacaagccaggcccacggcttggaatcccaggggtggctgtgacctgaggatgtggtcagtgagccgtggaattccaggacgctgatgtgatagtggatccagcccgcaattgactcagggaagagctgcaggatggagtcttctgtgatggtgccgtctgttttggcgtggcggtagacggaggtttcggaggcgaaccaggctcgccagctccagatataaagcagggcagggatgatcaccaaggagccgagcgctgggatgacgtcattttttagggtgccggtgacgtagcgtcggacgccgtagcgtttgcgcagccacaagtctaggaacacgctggtcaggccgaagaatgcgatgtagtacagtccggaccatttgacggagagcgcgagaccaaggaatacacctgtggtgaaacgccaccatcggaagccgaatcgggggccaaagtctttggtgatttggccgttggtgaggagtaaatcgttgaggcgttggtgcatttgttggtggtctcggatcaatgcccatgctgctgcggtgatgaagaaaacaaggaagatgtccagcatgccgaagcgtgatgagacgaggaggacgccgtcggcaagcgcgagaattccggcgatgaaagtcaccatggtggatccgctgaggcgccgcgcgattgccatgatggcgaaaatggtgagtgttccgaaaatggcgaccatgatgcgccagccgaggggggtgtatccgaagacccattcaccgagtgcttcaagttgtttggccaacggtgggtgaacgacgagtccgtagccggggttggattcaatgccgccggtgatggggttgatccaggagcggaccatgtcccaggcttgtgggacgtagtgtttttcatcaaaaactggggtgcctgaggcggttgcactgctcaaacctgtaaaacgcgtgactaaagcaaacaccgcgatgatcgcccaggtataggtatccaggcgggtccacttgaactttggcggtgcgggcgggagagtaccagcgaaaatcccctggtcccgcccctggtcacgaacaggtagggcttggctcactcggttgattgtagagccttggcgcgcatttgtgggaagctagatgcatgcatgttgctgaattatctttgcccactggaattattatcgcggcgactccgctcggcaacattggggatgcgtctccgcgcctggtccacgcgcttgccaacgccactgtggtagctgcggaggatacccgcaggacggcgtccttggctgctgcgttgggggtggaaattaaggggcagttggtctcgaactttgaccataatgaacaggcgcgcgtcggcaagcttattgaagcagcgcgcacgggcacggtgctggtggtcagcgatgccggcatgcctgtggtttctgatccgggttttgcgcttatcgacgccgcccacgacgcgaacattccggtcacctgcttccccgggccgtcagctgtgccaactgcgttggcattgtcgggccttcacgtgggccgctttgccttcgacggtttcgcgccgcgcaaacaaggtgcgcgcaccacgtggttggagtcgttgaaaaccgaaaagcgcgcggtatgtttcttcgaatctcctcaccgcatcgcagaaaccctggctcacgctgccgaagttttaggtgaacgacgcgtagcagtgtgccgtgaactgtccaaaacctacgaacaggtaaagcgtggaaccttgccagagttggcagaatgggcacaagatggggtgcgtggcgagatcaccgttgtcatcgaaggcgcgggcgatatcgcggccgacgtcgattcgcttatcgacgccgcccagcagcgcgtcgattccggcgagcggttgaaagcggtgtgcgcagacctcgcgaaaatccatggcgtgagcaaaaatgaactctacgatgcggttatttctgccagggaaaattaatcgttatgtcattgtgatgctcccgtgaacataaacgggacttactggctttacttaagtaacagctatgtaaaagaccaggtcaggttcgggtcggtttaggtacgaaacccatttttcggtttgctttccaggtttccccaagtaaaggtgagttttatgactacatctgacccaaatccgaaaccgatagtggaggatgctcagccagagcaaattaccgcaaccgaagaactggcgggcttgcttgagaatccaactaacctggaagggaaactggccgacgccgaagaggaaattatcctcgaaggcgaagacacccaggcctcacttaactggtcagtcatcgttccagccctagtcattgtcctagcgacagtggtgtggggtatcggattcaaagatagctttaccaactttgctagttctgcgttgtcagcagtagttgacaatctcggctgggccttcattttgtttggcacagtctttgtattttttatcgttgttatcgccgctagtaaattcggcacgattcgcttaggccgcattgatgaagcaccagagtttcgcacggtgtcatggatttccatgatgtttgctgcaggtatgggtattggtttgatgttctacggaaccacagaacctttaaccttctaccgcaatggtgtacctggacatgatgaacacaatgttggcgttgctatgtccacgacaatgttccactggaccttgcatccatgggctatctacgcaattgtgggcctagccattgcctattcgaccttccgagtgggccgtaaacagcttctaagctctgcattcgtgccactcattggtgaaaaaggtgcagaaggatggttgggcaagctcatcgacatcctggcgattatcgccaccgtattcggcacggcatgttcccttggccttggtgccctgcagattggtgcaggcctgtccgcagcaaacatcattgaagatccaagcgattggaccatcgttggcattgtttctgttttgaccctggcatttatcttctccgctatttctggtgtgggcaagggaatccagtacctctccaacgccaacatggttctggcagctctgctcgcgattttcgtgttcgttgtcggaccaaccgtgtcgattttgaacctgctgccaggttctattggcaactacctgtccaacttcttccaaatggcaggccgcactgccatgagtgccgacggcacagcaggtgagtggctaggtagctggaccatcttctactgggcatggtggatctcttggtcaccattcgtaggaatgttcttggcacgtatttcccgtggccgctccatccgtgagttcatcctgggcgtgttgctcgtcccagcaggtgtgtccaccgtatggttctccatttttggtggcactgcgattgtcttcgaacaaaatggggaatccatttggggtgatggtgcagcagaagagcagctttttggattgcttcatgcacttccaggtgggcaaatcatgggcatcatcgccatgattttgctgggtactttcttcattacctctgctgactctgcttccaccgtcatgggcaccatgagtcagcacggccagctggaagccaacaagtgggtgacagctgcctggggtgttgctaccgcagctattggactaacgctattgctttctggtggtgacaatgccttgagcaacttgcaaaacgtcaccatcgtggctgcaacaccattcttgtttgtggttattggattgatgtttgcgttagtcaaggacttaagcaatgatgtgatctacctcgagtaccgtgagcagcaacgcttcaacgcgcgccttgcccgtgaacgtcgtgttcacaatgaacaccgcaagcgtgaactggctgcaaagcgacgcagggagcgtaaggcgagtggcgcggggaagcgtcgataggcaatttttaacccctgatacccctttccggccgggcataaattaaggtggtacgcatgacgaagaacgtgctcgtatctgttgcctggccgtatgccaacggaccccgtcacattggacatgtggcggggtttggtgtcccctccgatgtgttcgcaaggttccagcgaatgtctggcaacaacgtgctcatggtgtccggcaccgatgagcacggcacgccacttctggttcaagcagacaaagaaggcgtcaccgttcaagacctagcggataagtacaaccgccagatcgtcgaagacctcaccggcctgggcctgtcctatgaccttttcacccgcaccaccacctccaaccactacgcagtagtgcaggaactgttccgtggtctgtacgacaacggttacatgatcaaggaaaccaccctcggtgcgatttccccatccactggccgtaccctgccagaccgctacattgaaggcacctgcccaatctgtggcaccgacggcgctcgtggcgaccagtgcgacaactgcggaaaccagctcgatccagcggacctgatcaacccggtgtccaagatcaacggcgaaaccccagagttcgttgagaccgaacacttcctgctcgacctgccagcactggctgaagcactaaccgagtggctgaagggacgcgaagactggcgtccaaacgtgttgaagttctcgctcaacctgctggacgatatccgcccacgcgcaatgtcgcgcgatatcgactggggcatcccaatcccagttgaaggatggcaagacaacaacgccaagaagctctacgtctggttcgacgctgtcgtgggctacttgtccgcatccatcgaatgggcctaccgctccggcgacccagaagcatggcgcaccttctggaatgatccagaaaccaagtcctactacttcatgggcaaagacaacatcaccttccactcccagatctggccagcggagcttctcggctacgcaggcaagggctcccgcggtggagaaatcggtgacctgggtgttctgaacctgcctactgaggttgtttcctctgagttcctgactatgtctggatccaagttctcctcatccaagggcgttgtcatctacgtgaaggacttcctcaaggagttcggcccagatgcgctgcgatacttcatcgctgtcgcaggcccagaaaacaacgacaccgacttcacctgggatgaatttgtccgccgcgtaaataacgagctggcaaacggctggggcaacctggtcaaccgcactgtatccatggcgcacaagaacttcggtgaagtaccagtacctggcgcactggaagaatctgacaagaagatccttgatcttgctaccgctgcctttgaatccgttgctgcgaacctggatcagtccaagttcaaggccggtatctctgaaatcatgcacgttgtcggtgaggccaacgcctacatcgcagagcaagaaccatggaagcttgccaaggatgacaccaagcgcgagcgtcttgccaccgtgctgtggactgcgctgcaggttgtttctgactgcaacaccatgctgaccccatacctgccacacaccgcccaaaaggtgcatgagaccttgggccgtgatggaatctgggctgcaacaccacagatcgtggaagtcaccaacgaatcaccacgccagccaatcggcgtggggctaccagatccagagcacacctacccagtaatcatgggcgactacaagacccagctggctaagtggcagcgcatcgacgttgtgccaggcaccaccttggagaagccagcaccgctgattgctaagctcgatccagaacttggtgaaaccggcccagaatgggcaccagtgcagaactaaagcatctttagcatgaaccgagcaggttgatcagaaacatctgattgacctgctcttattagttggcgggggtggggcgggggagtgtgtgtccaccccgtggtgttaggtggaaggcatgaacgcaacgagggaagaagccaacaacttactagctggaatcgccggacctggcgcacagctccgcgatgatcaatgggtagcaattgatgcattggtaaaccaacgcaaacgcatgctggtggtgcaaaggaccggttggggtaaatcagccgtctacttcatcgccgccaaactgttaagagcacgcggtgcgggcgcagccgtgattatttctccactactagccctcatgcgtaaccaggtggcgtccgccgaacgcgccgggattaaggcagcgacactcaacagtgccaatatgacggaatgggaaaccatccagcaacaagtcgtttcaggcgacgccgatgtgctgttaatttcacctgaacgcctcaacaacccagactttagagacaccattttgcctcgactagcagctgaaacaggcctagtggtggtcgatgaagcccactgtatttccgactggggtcacgatttccgccccgattatcgccgcatccgcgacctgttagcgggacttgcgcccaatattcccgtgctagcaaccacagccaccgccaatgaccgcgtggttgaagatgtccgtgcccaactaggagatggcacaggtttgcttcgtggtgggctagaccgtgaatccctttacctatcagtggtgaacctgctcaaccccaccgaacgcccagcttggcttgccacccacctcaaagaactgacgggttcgggcatcatttactgcctcactgtgtcagctgcacatgatcttgccgatgcacttaattctgttggatggaatgttgccgcgtacaccggtcgaaccgaagcaggagagcgcgaacgtttagaacatgccttgatcaacaacgagatcaaagcactagtagcaacctctgcactgggaatgggctttgacaaacctgaccttggatttgttgtgcacatgggcagccccagctcaccggtgtcttattaccagcagattggtcgcgccgggcgcggcaccgctcgtgccgatgtcatcctgctgccaggaactgaagacaaagagatctgggagtactttgcatcagtatcgttcccacgcgaagaggtagtccgccaactgcttgcggtgttaaccgatgaggcgcaatccactgtcaaattggaatcacaagtagatctttcccgatcacgccttgaacaagtacttaaagtgctagacgtagatggcgcagtcaaacgtgtacgtggcggatgggtctccaccgggcaagagtggatctacgatgcggaacgctacgcaggacttgaacaagcaaggaaaattgaacagcaaagcatggtgaactaccagaacaccactgagtgccgcatgctgtacctccgcaaagaactagacgatgtggaggcaactactccgtgcgggcgctgcgacaattgcacgggcaaaacgtgggggctcgacaccgatgcctcgatcactttgaaagtggaccaacagcttcaaacacccggagtgaaaatagccccacgaaaaatgtggccgactggcattagtgtcagaggaaaaatcgcagggctagaagaaggacgagcactgggacgactcaatgacattgcccgtggacctgcactaaaggccctgctggacagcggagcttattctgatgatccatggatggcacgcatcatcgaagtgctgaaaaactgggattggaccaaccggcctgccaacgtggtcgctctcggcaataccaactttggatcaactgagatgatcatccaggtagctcaatcaatcgcagcggtgggacgaatgaactttgcgggtgtacttcccgccgcgccgggtgctgaagaagtcatggctcagaattccgcataccgagtagaagccctattgaaacaatgggactggtcgcaaggcttgcaactagttcccggtcccattttgctggtgacagaccttattgatactggctggtcggtgacagttgcaggaaatggcattgcgcagcggacctcagagaaggtgctgccgttcgctttagcgagtaggggataggtgctctgggacgagagcaattggacgcactgggaaactagcaccatcttttggaactggccaaggacaagcaatcatcgcacccgttgcaggaaccttgtccaaattggtgaggttttcaatctgccaatggtcacggcacagccaccagcgctgtgcctccagtgaaggatctgtatcgggaagatcgtggccaatggcaatgactccacgggcatggaggatttctaaagcctcgatagaccagccgggtgcgatcccttgtttaccccattcccatccagtgtggagtgcgacgaaggatcctggttcgattttcccgtgtgtatgttcaaacgcttctatatcagcagcagtacatagatcggggcgagaaaacctcaggcaataaaggggtaaatgcgtttcctccacagggatctgatcaagcgtccgaccttgtggatcgaaatgtgcaggtgcatctacatgcgttccccagggaccaacaagtctgtattgatgcattaaaaagccatcgttttcaatcgtggagaccgtcttaatttcttgatctggatccccagggtagtggggttgtccgggcgcgaacgcatgagagagatcaatgatctgcatgggttaaagatatcggaaacttagtgaattctagggcggcgacttttcaggaagttgaggaaaagtaaaaagagtttattgccttatttggtacgatccttcgcttacaaaatattttgatgtcgtttgatgacttccaaggcaattcggcggttctttacctacccagcggtgagattgacgaagagtggtaggcgtttatcacagatcgaaaagaatcagagcttgtgacgattatcaatgatgagaatctgaaaaacctgaagagtctaaggcgtttgtcgagaccgccttccgcgatggtggaatccagtatcagtccacacgatggttaatggtgttgttacaaacagggatttcggctcactcactattggttagcgtccagcgcacgataggtgatagttctgttaattggttcgaaacgcgagtttgtaacaacatccagggtactaattcgtggggggccgaccaccacgacatcgagttcagcttggactttcgcgaatgcttcagcaggaaaaaatggcttccccccgtcctccagctgaactcgagcattagtcggagtgtttatgtagtcaaagaacttctcgaatacctctgtggtgagcactcccagcatctgggtattgtgccctgcgaaggcgaaagagtggatggttccggctggggcatgaacgtaatccccacgggagaggatgatctcttgaccgttgacgtgcagtttgacgcgcccgtccagacagatgaagttttcggtgtgaaggcggtggaaatgacgaggtatataaggcgtcttggcacccttggtctgcatagcgaggaactgatttccggtgtgtctcggacggcagacgaagctgttgatctgctcgaactgctcaagccggtccccctcaccatcgttcagggcaaacgccttcatatcttctgggaggcgatcgaaatgcggcccgagctcggcaaggtggtcccgctcatagaatgtgaatccgcaatcctccagttcctcgtagggaatccctgtgacctcgccactgacgcggaaggtgtgggagaacgaggacgtgccaagtttctctgccgcgtgtaggaatgcattcgaggatgagtagtacactagagctgaatttactaggccctcacaggcgaaggaccagggcgtattcgtaggaatggtggcactgccgccagcgatgatctcttgacgtccatcagcgaaccagagagtcaaccgcccctccatcatgtagaggaacgtcggtcctgcgacagagaagaaccgggtggcgggagtcttgcctgcgctcacacgagccagcgaaaatattccaccgttgtcttcgggacgggacataactgtgagatggtaggggccaagctggtgttgttgtccctcacctgcagccagagcatagggaactgactcgcagggaagtgaatccaggatcggggtcagggagtgacgcttttctacggtctcctcggaatccggtgtaatcgtcgtggggaggctggtggtagccatagcagaagccttctttcagtagatgatgagttgggtgaaggtagagtcttagcgaaggtgcagggtgaaaaagcgcttgatcatctcatggtcggcggcaagtccctgtagttcaaaggggtttcccggactctgctgcgcgctgaaatttgtctgaggctcccgctcgagccgaccattgtctagtcgaacgtttggccccagctccgcgacttccccgggattgaggaaaccgtggccaaagccctcaatgagtaccagggtggactgccgaccagcctgcacaagatgggtgtgcagcgcagccgattgctccggagggaccatccggtcaccagtgccgtgcatgatcaggaagggcggtgcctgtgccgcattctgatgcaccggactggcgtcgactgcgtactgcagctggtggtcgtagttttccggcgaggttgcagctccgccgaggagatcttgctcaggcgtcgtcgctggattattcccggctgtgttgacctgtgtgtatgcaggtaagagcttttcgatctgggtaggtccgtagccttccataacgcagcggacatgggaggacacccctggtaatcggtggggagctcttctaggtcagtgtgcttgaggttgcccagcaaggctgccatggcagcgatatgccctgcgcccgtatggtgatttgagacagggtttaggagaattagttccatgtcgaatcgcacgtcatcttcaccgaagaattcaaagcaggagctgtgcaactcgtcgtatcctcagggcgctcggtcaaggaagtggccaccgagttgggtatcaaagaaggaacactgagcgcgtgggtaagaacctggagggccgagcatccagacgccggtgtggatgaaccaggcccagtcgaatgggcgaaatacaaggccctgcaggctgagaacgccgcgttgaaacgggaaaacgagttttggggaaaagccagcgccttctttggaagccgaagcacctgtagaggatctctcagcgttcatcgagcaagagaaggcgtcgtttcccattacatggatgtgcagaaagttgggtgtgtccagagcgtcgtattaccggtgggccaagcctgcgggtctgactccgacagccataaggcatttagaactcagggctgaggttgcccaggagtttgaaaaaagcaaccagatggctggcagggatcagctgaccacgttgctcaaccagcgtggtgtcaaagtttctactgggactgtgggatcaattatgaacgaatgaggagtgcgtgtcagacgaatgcgggcctggaagaacaccacggtcagtgaccctttctgcccggaccgagcatattaaaaatcatatgctcgatagccacgggaaacgagactttaccgctaccgtgcctgggaccaggctcgttggtgacattacgtacttaaagacgggttccgggtggctgtatgtggctaccgtgatcgatttggctacgcggatggtggtggggtggtctatggattctaatatgcgcacaccgttggtgatcaatgcgctggctatggcgcgtgatcatgggtgtcttcatcctgaaggcgcaatttttcactccgatagaggatcgcaatacacctccgagcagttccagacatggtgcgccggcaacaagatcacccaatccatgggattgaccggggtgtgttgggataacggaagtcgcggagaattttttctcacatttgaagaccgaaatgtatcaccactatgattttgagaatcacctgtcggaccgaaccgcggtgatggagtacatcgaggggcaggtcacaaccggcgccgcccgcatagcaataaccaggggctctcaccggctagtgctttgaccgcatatcagcagcagtatggattagcagcagcgtaagaagaaaaatcaatcaagctgtctcaaaaacttgacgagcgcaacctgggggatctaccagcggatgatcgcggcctaccgcgagaaggaccgatccctcggccgcgcggcgatggaggcgctcatcgacgccgtcagccaagacgtccccgccgggctggacgagttgcgcaagctcggtcggaccctgaaggctcgcgccaccgacgtgctggcctacttcgagcggcctggcaccagcaatggccccacagaggcgatcaacggacgcctggagcacctgcgcggctcggccctgggcttccgcaacctgaccaactacatcgccagatccctgctcgagttccggcggattcagacctcaactacaccctcatctgtgaagagccgctttagacatccctcatcgtcacggaccactatgaacgatgtcccgactcacctatgaacgatgtcctgaacctacacaccttcagctccaccaatatgttcaggcaatgtgtttcagcaatagcctccgggctcgtcgatgtggccggtggcgaggatttcgccggtgtgccggccgtcgcgggtcagctgacggcgtgaggcgatgacccgttctcggaccgggcgtggccctcgccgccacgcgattctatggcctgcccagcctctgaccgatgtctcgactcatccgtcccggtggacctagggagtcgagccctaggtccacccgagatggataagacatcgctcaggctctcacggcgtcgcgctaccttggggacttaggcccagtccttgtgcggcgacgtgccgccgataccggcgttgaacgtattcgtcggatcgagctccttgaagtgctcttccatggactccggcagcttgtagatgcgaccgtagttgtgctcggcgggcagcttcgcgccgcgctcctccagcaggtgctggatgcggtcgtgcagcgcctcgagatccacgccctgcttggcgacatagtcctggtgcatcacatggcagaagaagtgcccgtaatacgccttgacctcaagctggtcgtcgatctcctccggcagcacctcgagccagttccaatcgtcgcgacgcagggccacatcgatggggatgagccctgcgatgtgccggcgcttcaacgcggcgtagcgagtggcggcactggccgcgccgaaccggttgagcgacgcgctcttttcttcatcagacgtgcagatgaagaactcaccagtgtgctcgggctctgcgaagaactccttgagcatcttctcgctcgcggccttctgcgactcgctgacggtgagcagcaggtgatgctcgaaacggttgcggtactccatcatgcgcttgggcagctggttgggcagcacgctgaacatggcttgcgataccgtgtcggcgaaggtcggaccaatgccgggaatcttcgagaacaagccgttggcccacgtcttgaacgagaacatgcgcgtctgcagcgctggactcatgaacttcaggaagacgaaggtgtctttgccgtacttctcggccaagtcgaaggcactgcggcccatgtactcaccagagataggcagcggcatgtcggcttcgaggaacaaccgacggatctcttcgagctcgtgcgtgttgttcgtgccgatgtaaaacacggtcgggtgcacttcgcgagggaaggtgcgggtgcgcaccgcgaacaccatcagcttgccggccgagccggaagcctcgaacaggtactcggggttcgcattgtagcgagcaggcgaaggcacgatcttgcgcaagtgctcggcgtactcggtctcgttcgagtcttcgggagctggggtgacatcctcgggagaccactcgccgcgctgtagacggtcgagtgcgacctcagggtcgtctccgagcgagatgcccaggtgattgaccagctcgaccttgccgtcgtcgttgacgcgggcgaagatcgcttcgcgcgtgaatgccggacccttgcgaatctggctgccgcccgagttgttcgcgatgccgccgatgaccgaggcgccgattgatgtcgacccgatcaccgagtgcggctcgcgctggtgcttggcgagcgcgtcggtcaggtgtgtcagcggggtgcccgcgagcgagatcgcctcgcgcgcgtcgttgatgaggtgcacctcatcgatgcggtgagtcgagatgatcacaatggggcgatcgtagtcttggaagccggggccggatccaccagtcaggcccgtgttcgatgcctgcgggatgacgatgaggttgttgtcgacggatacctgcagcgcccgccacatctcgaccagcgtgccggggcgcaccacggcgaagactggtcctccgccgaatcgatagcctttgctgaatggcatcgtggcacgctcagaggtcagtacatgttcgtcgccgacgattctcttgaacgcatcgatcgcttcgtgcgaagtcgtggtggtctgtcctggttgcgtcatctctaagcttcctatattcagttgcatcacaagcgcgtcatgatgctgaggggatgtcgccttgatccgagctagtccgcggtcgttcattttttgatgggcggggaaacgagccagggggacgacgtctgcgaccgtctgcccggaagctcgctacggcgtccaaggagtgtgcgtgtgcgtatgcatgtgcatacgcgcatcctcattgtacaagatgcgcatcagatagtttcggaccgcggtactttcggactccggtaggttcggaccgcggtactttcggactccggtaggttcggaccgcggtactttcggactccggtaggttcggaccgcgatagttcggaccgcgatgtcggccactgccctcaccccatagatcgacgcagcaatcagactcgcctagcgccgcttgaaccgtcccaggtttggtggctcttcacagatgagggtgtagcgcgtagtcaaggatcgaacggcgtggcgctgcccgggtaggcccctccttcatgtcccgcctaataggccagatcggcgtcaggccatcctgcggactgaagtcaggagtttcgtcaagtggcaatgcttcgcccgcgtggctgagtcgcccagtcgactcatcgaaccacaccggatagaacatatctttacggtcagctcgaagcgagtcgtcgcccgaccgcaagagccccttccatcgaggcctctgcagttccccttcagcatcggccatgtctcgatgcgtcagaaggtcgtcatcgaccgaaccgattcgcgcgtcaggaccaaatacaaagaacgcatactcttcgaccctcgaaagatatccctgagtaacgcctttagggttgttgacaattgtgacgagttgccgcgtagattccgggaagagctgatctagcaacacgcccaaacggtttacttcatgctcatcgatagttgccacaagagtagcatcgctacgcatgagctcccgacagatcttcaaccgtcgctccatgaacgccagccatttcgagtgtcgatagtcgtcatcactcgcgacgtaatcgttgtcgtacttccagtccctcgccccggtgttgtacggcgggtcgatgtagatggcgtcgatggaatgccggtgcgtataggtcagcatctccagcgcgtggtagttctcagcgttgacgaccgtgtggaacggcttgtcgccgccccgctcaaccctgcctgtctccaccaggccggggtagatgcgatcccggaactccgcgacgaccaccacgtcgtcggcaagcactgcccgagtctcgggttcttcgacgtcgagctccgcgagatgagccacacgctgcccgtcgacgcactcgatccgagttgtccgccacagccgttggtcacctgcctttgtcccccctcgcggaggcagcacccgcaccttgtcgccgcgacggacgaccctgccgggcagctcgacagcctcaggctgatgctgctcaaagacgagcccgaaggtgcgacgcttggtcagcgcagcgacctcggcttccaggtcagtaccaagttgcgcgtccgccttgcgcacctgccgcagcagttccgtcagtctcgacacggatagggctccttcgtcatcatccgtagcgcgtccgggctatttcttacttccagacgtaagtcccgtccggaactccaccacgtgatccttcaacctgtatgcaactaatctagccagtttaggactaacaagaatttctctcttgatttacaaatacacatatatttgtgtatttgtaaatcaatcttcgcactcgttaaggtatctgactactgattgctctacgatttctttcatcgtgcgatgttctttaaatgcctgtagtttcaaccgtctatgcacactggtggtcatgcggacattgaacatagtgctttcctcagtcttggaggcggaattggtatcgacaaacgcttcaacaatggagcggcgctggtggggtttccccggcccaagactcaactttgcaacagcaccttattaagtgccctagagttattcagccttagggcaccgctctatttcttacggcatttcccacttttctcaatggcttaaagagcatgaaaccgcaggaaaccgttgtatttctgacgtgcgaccacattatgtaaaagactcacctgtcagggatctatctccttgtagaggaactattccagtcttctttaaaaacacttatgatcgctgtgatcaggtaatttaatgaaaaaacttatagcgttaaaacgtgatgattttttgacgtcaaaaagttttagcactataacgttatgacgttttagtgctaaagtgtggcttgtcagattcgtgttggtcgtgcgcccgtatggtgatttgagacagggtttaggagaattagttccatgtcgaatcgcacgtcatcttcaccgaagaattcaaagcaggagctgtgcaactcgtcgtatcctcagggcgctcggtcaaggaagtggccaccgagttgggtatcaaagaaggaacactgagcgcgtgggtaagaacctggagggccgagcatccagacgccggtgtggatgaaccaggcccagtcgaatgggcgaaatacaaggccctgcaggctgagaacgccgcgttgaaacgggaaaacgagttttggggaaaagccagcgccttctttggaagccgaagcacctgtagaggatctctcagcgttcatcgagcaagagaaggcgtcgtttcccattacatggatgtgcagaaagttgggtgtgtccagagcgtcgtattaccggtgggccaagcctgcgggtctgactccgacagccataaggcatttagaactcagggctgaggttgcccaggagtttgaaaaaagcaaccagatggctggcagggatcagctgaccacgttgctcaaccagcgtggtgtcaaagtttctactgggactgtgggatcaattatgaacgaatgaggagtgcgtgtcagacgaatgcgggcctggaagaacaccacggtcagtgaccctttctgcccggaccgagcatattaaaaatcatatgctcgatagccacgggaaacgagactttaccgctaccgtgcctgggaccaggctcgttggtgacattacgtacttaaagacgggttccgggtggctgtatgtggctaccgtgatcgatttggctacgcggatggtggtggggtggtctatggattctaatatgcgcacaccgttggtgatcaatgcgctggctatggcgcgtgatcatgggtgtcttcatcctgaaggcgcaatttttcactccgatagaggatcgcaatacacctccgagcagttccagacatggtgcgccggcaacaagatcacccaatccatgggattgaccggggtgtgttgggataacggaagtcgcggagaattttttctcacatttgaagaccgaaatgtatcaccactatgattttgagaatcacctgtcggaccgaaccgcggtgatggagtacatcgaggggcaggtcacaaccggcgccgcccgcatagcaataaccaggggctctcaccggctagtgctttgaccgcatatcagcagcagtatggattagcagcagcgtaagaagaaaaatcaatcaagctgtctcaaaaacttgacgagcgcagggtgtcccacttcctaggaagtgggacaccctgatcggtacgtgggccgccgctggtctgggccggaagctgccggcaatagccctcacctttaaatcacgtcgggaacaccgccaactaggcagccgcttccttcctgcgcagtgaaggcctcagcctgaaagtgcagacgacctctggcaacgacgccaccccatgttgaagttagttcagcaacagctgtatagttcagcgcatgctgactattgcttctcgtctagacgtgatgaaccggttgggtcgggccatggcggatccgactcgttcccgcattctcctggcgctgctggaggggccggcctacccggccgctctcgcccaggatctggaactgacgcgctcgaacgtgtcgaaccatctcgcctgcctgagggactgcggaattgttgttgccgaaccgcaggggcgacagacccgctacgagatcgttgatgctcatctggcgcaggcgttgaacgcgttgctggatatcaccctggccgtcgatgacaacgccgaatgcatcgacgccggatgcgccgtacctgggtgtgtcactggacaggagagtgcgtagtggcaaccggtctactgtcggcgattggtctgtttatcgccaccaatatcgacgacatcatcgtgctctcgctgttttttgcccgcggggcggggcaaaaagggaccacgcttcggattctggctggtcagtacctcggcttcatgggcatcctcgcggccgcagtcctggtcacgctgggggcaggagcattcctacctgctgaggcgatcccgtacttcggactaattcccctggccctgggactatgggcggcctggcaggcctggcgaagcgatgatgacgacgatgatgatgcggagatcgccgggaaaaaggtgggtgtgctgaccgtcgccggtgtgacgtttgccaacggtggcgacaatatcggcgtctacgtcccggtcttcctcaacgtggacactgccgccgtcatcatctactgcatcgttttcctcgtcctggtggcaggcctggtcctgctggcaaagttcgtggccacccgcccgcccatcgcagaagtccttgagcgctgggagcacgtgctgttcccgatcgtcctgatcggcctgggcatcttcatcctcgtcagcggcggcgccttcggcctctaataagcccatcccgagcgcccgggtggcctatccaggtgttgccatcggcgtcgactgaaccgccattcgaagccgcggaaaaaccgccaaacgaagctgcaagtcacaatttccgctgtttcattaagcaccaaaccattagttttgatccccgattggaatagctaataaccctattaagacagagaacgggcatgccatgctgtggcatctacaaagttctgtgctgtgaatgcaaggtcaggtccgtctgtttttcattgggtgtacaagctcaatcactattcgcatgaaacttccttacttcggataagctgggtttagtgctgatgtgacacgtgtgaaatgcagttatgtcacaaagcagttatgtcacaaagcagttatgtcacaaactatcgagttgcaacgccatcttcttgttgcccaacgaaacggatcttaactagaagagccaggtcttgtttatttcggctactgattcagtagctgcgctccgataggattcttagttttcagttcagtatctttgagccacggctagaatgtgaatcctatgtctaagaagaagcctcgccccattccggttcctgcccaatttatccctggtctcattgatgcgcatacacatttggcatcgtgtggaggagatcttgcagggttggtggaaagggccaaggaggcgggcgtcgaaaagctttgtaccgtcggtgatggtttggctgaggccgagcttgcgctggaggccgcgcaacagtttggcaatgtgtttgctgcgtgtgcgattcatccgacgaaggctgatcagttggatggggctgcgcgtgcgcggctgacgcagatggcggcggatccgaattgtgtggccattggtgagactggtttggattcgtattggatcaagcacgatccagaggacacggcggcgttggatgtgcaagaggaggcgctgcgctggcatattgatttggcaattagtgcggataagccgttgatgattcacaatcgtgaggcggatgctgatttgatgcgagtgttggcggatgctccacctccaaaagatacgattctgcattgtttttcttcgccgttggacgtggcgaaggaagcgttggatcgtggatatgtgttgagttttgcgggcaatgtgacgtttaagcgtaatgaggagttgcgggaggctgctcgtattgcgccgatttcccagattttgattgaaaccgatgcgccgtatatgacgccggagccgtttcgggggagtaggaatgagccgtcgttgattggtcatacggcgctatgcattgcggaggttcgggggatggctgtggaggatgttgcggcggctttgaatgagaattttgatcgcgtttatggggtcacaaatctataacgtgaggtagctcacagtcaatctgttggccgtggtcagctgtgggggttgtggtgggtgtgactgaagtttatgaagttgcacgccacggcgttttggtgatggacgggggtagtttgttaccgtattgtgactaattgttaattcccccgagagcgaagaagttttacatggcgccccatcagaagtcacggatcaaccggatcaacagcacccgctcggtgccgttgcgtttggctaccggtggcgtgctcgccaccttgcttatcggcggagtcaccgctgcagctaccaaaaaggacatcattgttgatgtcaacggcgagcagatgtccctagtgactatgtccggcactgttgaaggtgtgctggcgcaagctggtgtggaacttggtgaccaggacattgtttccccttcactggattcatccatcagtgatgaagacactgtgactgttcgtactgccaagcaggtggcgctcgtggtggaaggtcaaatccaaaacgtgaccaccactgcggtttccgtggaggacctcctgcaggaagtcggtggcattaccggtgctgatgcggtggacgctgatctttcagagaccatcccagaatctggtttgaaggtgagtgttaccaagccgaagattatttccatcaatgatggtggcaaggtcacttacgtttctttggcagctcagaacgtacaggaagccctagagctgcgggatattgagctgggtgctcaggaccgcattaatgtgcctctggatcagcagctgaagaacaacgctgcgatccagatcgaccgcgttgacaacaccgaaatcactgaaactgtgtctttcgatgctgagccaacctacgtggatgatccagaagctccagctggcgatgaaactgtggtcgaagaaggcgctcctggaaccaaggaagttactcgcaccgtaacaaccgttaatggtcaggaagaatcttccacggtgatcaatgaagttgaaatcaccgcagcaaagccagcaaccattagccgtggcaccaaaactgtcgctgcaaactccgtgtgggatcagctggcacagtgtgaatccggcggaaactgggcaatcaacacaggtaatggcttctccggcggcctacagttccacccacagacctggctcgcatacggtggtggagctttctccggtgacgcttccggtgcaagccgtgaacagcaaatctccatcgcagaaaaggttcaggctgcacaaggttggggagcatggcctgcttgcaccgcaagcttgggcatccgatagtagaaatctggcatccaataggtagattgggatgctatggaagaaccctcaggtgcacagctgctcggcccggtagaaatccgtgcgctggcagaaaagctcgacgtcacaccaactaagaagttggggcagaactttgttcacgatcccaacacggtgcgtcgcattgttgctgcggcagagctcaccccagacgaccacgtggtggaagttggccctggtctgggctctctgacccttgccctggtggaatctgctgcttcagtaactgcggtggaaattgatccccgtttggctgcggaattgccggagacttttcagtggcgcgcgccggcccttgctcacaagttgagcatcgtgctgaaagacgccctgaaggttcaacaatccgatatggctgttcaacccaccgccttggtggctaacttgccgtacaacgtctctgtccctgtcttgttgcacatgatggaggagtttcccaccatcaacaaggtgcttgtcatggtgcaggcagaggttgctgatcgtttggctgcggatccaggatcgaagatttatggtgtgcctagcgtgaaggcgtccttctacggtccagttactcgcgccgggtcgattggtaagaatgtcttttggccagctccaaagatcgaatccggtttggtgaagatcgtgcgcgaagacaccgcgtggaagcaggacgatgagacgcgtaagaaggtgtggccgatcattgatgctgctttcttgcagcgccgtaaaaccctaagagctgcgctttctggacactacggttctggccaggcagctgaggaagctttgcgggccgctgatattgatccaacgcttcgtggcgaaaagcttgatgtcactgactatgtgcgcctagctggggtgttgcagcaaaaggatgagaagtgaaaattaccgctaaggcgtgggcgaaaaccaacctgcatttaggtgtgggaccggctcacgacgatggatttcacgagctcatgacggtgtttcaaaccattgatctgtttgacaccgtcaccttaaccaccctcgatgaggagttggtggaggaggggagcgtcgtcaagcaattatctgtgaccggtgcccgtggcgtgcctgaggacgccagcaatcttgcgtggcgcgctgtggatgcgttggttaagcggcgcgcggaaaagacgccgctgtctgcagtttcgctgcatatttccaaggggattccggtggctggcggcatggctggcggctctgcggatgcggctgcgacactgcgcgcagtggatgcctggattgggcctttcggcgaggacacattgctggaggttgccgcggagctcggctcagatgtgccgttttgcctgcttggtggcaccatgcgcggtaccggtcgcggcgagcagctggtagatatgttgacgcgcggcaagctacattgggtggtggccgcgatggcgcatggcctgtccacgcctgaggtattcaaaaagcatgatgagctgaatccggaatcgcatatggatatcagcgacctcagcgccgcacttctcaccggcaacaccgccgaggtggggcagtggctgcacaatgatctgaccagcgccgcactcagtttgcgccctgaactgcgcagcgtcctccaagaaggcatccgctccggcgcgcatgcaggaattgtctccggctccggcccgaccacggtattcttgtgcgaatcggagcacaaagcgcaagacgttaaagaggcgctaatcgacgccggccaggtgtacgctgcttacaccgccaccggccctgcggcctcaaccgccgaccagcgcggcgcacacattttgactgtttcataataaagacaaacttaagtatcggagtcgaagaaaaaccacaatggccaatctgattaatctcgagaacgtctccaaaacctggggattaaaaacgcttctcgacggtgtctccttaggtgttcaaaccggcgaccgcattggcgtcgtcggcctcaatggtggcggaaaaaccaccctgctggaagtacttactggcatcgaaaagccggatcagggccgtgtgtctcacaactctgacctgcgcatggctgtggtgacgcagcgtgctgaactcaatgatgacgacaccgtcgctgacgtggtgcttggacctttgggtttggaagttttcgaatgggcatcaaacgccacggtgcgcgacgtcctcggtggcttgggcattgtcgatcttggccttgacaccaaagtgggcaacctttccggtggcgagcgccgacgcaccaacctggccgccgcgctggttcgcgaccttgacctgatcgtgctcgacgagcccaccaaccacctcgacgtggaaggcgtgcaatggttggcgtcctacctgctgtcacgccgcatcgccattgttgtggtcacacacgatcgctggttcctcgacacaattgccaccaccacctgggaagttcacgacggcgtggtggactcctacgaaggcggctacaacgactggaccttcgcccgcgccgaacgcgcccgccaagcagatgccattgagcagcgccgtcaaaacctcgcgcgtaaagaactcgcatggctgcgccgcggtgcaccagcacgaacctcaaagcctcgataccgcatcgaagccgccgaagctttgatcgcagacgtgccagcaccacgcgacaaagtcgagctcatggcattttccaagtccaggcaaggccgcgttgtcattgaacttgaagacgccacagtagccacccctgatgatcgcatcctggtagaagacctcacctggcgtttggctccaggagagcgcatcggtcttgtcggcgtcaacggctccggcaaaaccaccctgctgcgcacccttgccggcgagcagccacttcaggcaggcaaacgcatcgaaggccaaaccgtcaaactgggatggctccgccaggaactcgatgacctagacctcagccgccgactcatcgactgcgttgaagatgtcgcttcctacgtgatgatgggcgacaagcaggtctccgcttcccaattggcagaacgcctcggattctcacccaagaggcaacgcaccccagttggtgacctgtccggtggtgaacgccgccgactccaactcacccgcgtgctcatggccgaaccaaacgtgctgctcctcgacgagcccaccaacgacctggacattgacaccctccaagagctggaatcccttctcgacggatggccaggcaccatggtggttatctcccacgaccgttacctcatcgaacgcgtcaccgactccacctgggcactcttcggcgatggcaagctcaccaacctgccaggcggaattgaagagtacctgcagcgacgagcagcgatggccgcggccgaagacagtggagtgctgaacttgggtgcggccacgcaggctggaaccttttctgctgcaacagagcaggctgccacttctgtggaaagttccggaatttcttcccaagaacgccaccgcatcaccaaggaaatgaacgccctggagcgcaaaatgggcaagcttgaccagcaaatggacaagcttaatcagcagctcgctgatgcagcggaggccatggacaccataaagctcaccgagctggacaccaagctccgcgcagtgcaggaagaacacggcgagctggaaatgcagtggctggaactcggcgaggaaatcgagggctagttcatgccgtcggcaggcgaggagattttagagcagcgcgcacagctggagtttgatcagcgccgcgccgatgtggtgatgatcggcagccaggtggtttatggttccgtggggctcagtgctgccattccggtgatgcacaacgaaggcctccgcgtggtcgctgtccccaccgtggtgttaagttccatgccgcgttatgcaagttctcaccgccagccgatgtcggaccaatggctcgccgacgcgctgcaagacctggtggatctggggattatcgatgaggtttccaccatttccaccggctattttacctccgcttctcaggtgcgtgtggtcgctgcgtggctgcagaaaatccgcgaaacccatccgcatgtgcgcatcgtggtggatcccatcatgggggacagtgacgtgggaatttatgtcgccgacgagatcgcaaccgccatctgccaggacttatgccctctggctaccggaatcattcccaatgctttcgagctctcccacatggttggctccggcgatccgcgctcgctgctcggcccgtttggcgagtggatcatcatcaccagcgccactgaaactgtgggcaccaccgtcacccgcatcgtcacccgtgacagcgtccaggaaatcgcctccgccaccgtcgataccacggccaaaggggcaggcgacgtctacgccgcagcattaatcgccgccctgcataaagatttttcgcttatcgacgccgccagccacgcatccaacaccgtctgcgccggcctgcagaccaaagcgctttaggtttcgtccgtctctgacagcaaactgccgagcagcaatcccagcacgaaatcatcaacctgcccgaactgcacctgacgaatccgtccttttcgatcagccaaaatgatgctgggcgttccttccaaacgatactttttcatcgtcgaaggaatccgctggccttccctcggcatatccactgccacggggaacttgatcccaaactcatcgatgaacactttcaaagcctcaggtgtcatcacatcatggtgctcaaacacgctgtgcagcccgatgacttgcacttgggattcatcaatcatgcggtggattttttgagcctgagggacaccgtgattcacgcatccagggcatagcatctgaaacacctccaccaccacaaccttgccgcgcaggtcctcattgctcaagccttcgtggtttacccattcctgaacatccaattccagcagcggggcattgtcgagcgaactcatggtttaactcccttcatgaaatgtgtgcggggtcactggttcccagcctagtctgaactggctaaacaagatcggtacagtggtggtcgtgattttgattaatgtgaaattcaagccattgccagaatatgtagacaccttccgcgagcaggtagcggagtttacagaaaagacccgtgcggaagaaggaaacatcttcttcgattggtcaattaacaccgacaacccaaacgagttcatcctcatcgaagcattccaggacgacgctgccgaagctcacgtcaacagcgaccacttcaaggcggcctgtgagctgttcccaaccatcctgtctgagaccccagagatcatcaacacccttatcgagggcaagactgagtgggaccgcatggcagagttcgcagtcaactaaaatatgacctttgctggttggctaattttgggtcaaagttttgtgaaacgaagtaagcttaagttatgcatatcgtcaacattcgcttcaagcccaaggctaagtacgtggatacattccgctacacagtcgacaaattcactgagtcaaccaggacagaggaaggctgtctctactttgattggttccgcaacaccgattacccaggcgagtaccttgtaattggtgtgtggacggatgaaggtgcgacggaacataagaagagcgagcacttcttgcgagctcaagaaacacttccaccgttgctgcaacaaactccaatgattattcagagtgagttttccaagaagaagggttgggaacgtttcagcgatttcaccgtctactaaggagcccgcaaaagctttgttgctagcggaaaggctttagcgacaaggctttttgcatgttttaatgcagggaatattaactttttgttaatctctgaccattgaccttgtacgcttaaaacatgcgaaagaaaaaagacggtcaaaatctcccagacttccggaaaaatccgccaaagctggataaaaaggcttatgaaaaagaactaaaaagacttcaagccgaactcgtcgatttgcaacaatgggttgtggaaaccggtgcgcgcgtggtcatcgtcatggaaggccgcgacgccgctggtaaaggttctgcgatcaagcgcattacgcagtacctcaacccccggtccgcaaggatcgaagcgctgcccaccccaaactctcgggaaaaagggcagtggtatttccagcgctacatcgaaaaattgccgactgctggtgagatcgttatctttgaccgctcctggtacaaccgtgcaggagtcgagcgcgtcatgggattttgcacctcccaggagtaccgccgattccttcaccaggcaccaatctttgaacgcctgttggtggaagatggcattcacctgcgtaaatactggttctctgtatctgatgaagagcagattgagcgtttcgaagaccgcctgagcgatccgctgcgccggtggaagttgtcgccaatggatttacaatcgatcacccgctgggaagattactcacgcgcaaaagatgagatgttcatccacacggacatcccgtcagcaccgtggtacacggtggaatctgaggacaagaagcgttcccgcatcaacgtcatttcgcatctgctctcgacgattccttatgagaagatcgatcgtccattgccggaaatccctcatcgcccagattctgaatctgattatgtacgtccccctcgcgatgagttccgttatgttccagatgtggcagcacacttggaagaagagcgcatcaagaaagaagaaaaagccaagaaggcaaagaagccagctaaggctgcaggaaagaactcggataagcagaagtcttccggaggaaaaggcaagaagaagtccaagaaatagaacgccttttaaggggttgaaaagccccaaataggactcagtgtgggtggggctcgttcaggcgcttaaaagtgattctggaagggctccattttgaggctggtggggcacaagtgattcttgaacagttgctacaggattactgatcaacttctcgtcacgaatcgctggcgagtcctaaaatcgaacgaatatttgcataatagggatctattagagcgaattttcgatcgaaattggacatttgctgcggtccgggggcggattttgcggttcgccaggccttaagcctcaaaagctactttctgaaagtctcctgcaaggctccagggcaaggactcaccacaccgcctaagaatcgacggatctgtggtggatcctaaccatttcgcctgaacctgctgcctgcaatcgttaaccgttaagcaacttctccagcaccacaataacgccctcttcaatgttggatggtgcaatttcgtcggccaattccaaaatgtccgggtgggcattggacatggcgtaagacttgccggcggccttgatcaattcagtgtcgttgaggtagtcgccaaacacgagagtttgggattcttccaatccgagggcatcgcggagagcagccaaagcttggcccttgttggctgaaggatccatgacatcgacccagtgctggccggagacaacaacgttggcgttgggggaggctgcgcggatgatgggggcacagtccttttcggcatcttggaatgtaaagatcgctaccttgattacttcattgttgactgcttcgtggaggtcttggacttcctcgatggagacgtagtatttcaggccttcggcgcggaaagcttcgtcgttgcgttcgacgtaggcgcgttctggtcggcagaccactactcccatatcgatgtcggatgcgcgcacggcatcgatgatggagtgtacggtgtcggagtcgatggtggtcagggagataatttcgccgtcgtggactaccacggtgccgttttctgcgatgtaagaaatgggttcacccgcgtgcccgaattgtttttgcaaggtggctaattgacggccgctggctggtgcgaaggcgattcctttggcacgcatttgttccaggatgtcccaaaatttctctgggacttcgtggtgggtgtttaaaagtgtgccgtccatgtctgtcgcgacgaggcgaaagtccatttgtttggattcctttccgattatgtcttgatcgcccattctgtcacatccgggttgtctaaacacccgcgaagatttcctgtgatgtgccacactggttctcatgtctaacgtagtgaacacttttgtccagaattccaccggtatggtggagcttaatcgtcccaaagcgctcaattctcttaatcaggaaatgatcgatctcgttcaggaagctctaaccacttgggctgatgatgatcaggtgcagcaggttctcatttactcatcctcggagcgtgcattttgtgccggcggtgatgtgcgcgcggtccgtgagagcgtgttggagggcgatgttgcggccggcgataagtatttcatcgatgagttcgcgatgaacaacacgttgggaacctatccgaagccggtcatttctgtgatcaacggcgtcgcgatgggtggcggaatgggaatttccatgcatggatcgcaccggatcgtcacggaaaaagcgttcgcgtcgatgcctgagatggcgatcggctatgttcccgatgtgggctttacttatttcggtcagcgtgcatcgtcgctggccatcgccacatttttggcggtgaccgggtggcgcatgagccctgccgatatgctgtgggctggcgtcgcaacgcattttgttgaggatgcgcaggggttcattgatgcggtcttgaacgagtcgcttgatggcgcgctggagaaattctccacgcaacctacgggcagcagcgagctggccggcgtcgccagccagattgaggagacctttgggcacagctcttgggcgcttatcgacgcctccctccggtctcaccccgatgctgaatttgttgccaaggtggatgggctgatggcgtcggcagcaccggcatcggtggtggctaccgtgaagctgatgcatcaaaacagtgaggcgaccactctgcgtgaaggcttggacaatgaattggcgatgtctctttatatgatccgccagcctgattttgctgaaggtgtgcgtgcagtgttggttgataaagaccgcaatgcagccttctccccagccaactacgaagatgttgatgagtcacattttgtgaccttgttccagcgcagttcataaaaccgccaaacttttgatagcgtagcaatggccctttcggtggatggggccatgtttgcacaatgcttgaagaagggtagggcagtgaagccgctgggcaagatcgccgttccttggacttggtacctgggaattgttggggtcatcatatttgatgtggtggcagcaataacgatgctcaccctcgtgcccaacaaaatgcccgaaagagtcaacagtgggcttgtcgcgctgggtggatcgtatgcacccccgatgagccgggaaacactcattgccagagtcattgccggtgcagtgctggttctggtgatttctttaggtatttcgctgctgatttccgcgcagtccaagaacctcgcgtccgatcacccggatgcatctgccattcagattgctcggcgttgggcgtttttgaacaatattcaaagctgtatcggctggtttagtttcttcctcgcagcgattttgagcatctcatcgctaagactcaacggcccaggtgccaccacgcatcttgagatggccgtttacatcatcgctgtgtcggtgttggcttgggcgttgatgatttccttgcgacgcggccaggtggcgattgatcgtgccattccaattcgggaagatgattccgaactgaaatggggcatgatctaccacgatgcttcagacaaacgagttttcgtggaactcgatgatggccacacgaccgtcatcaacatggcgcgcgggggagcgtggctgctcatcgcagtgatggtgctgcctgcgctggccatcgtcggttgggttttgctagaaaactagcccacctttgttaaatgctcgccgtcaaaagtcacgccgacttgttggccctcaacggtgagtgcgtagccatcaaaaggaagctgtcggtgagctgcataggacgccaccgcgcggcgggcatcaatatcgcctggtagctggtgatacagcgtggcctcaacagctgcatgtgatgctggcggaagctgcagccgaggatgatccagcagcaggacaattccggtgccatcaggttgctgcacgatggtgtgcgtccaagtgttgagcacctgtttagccacatcaatcaggttgaatgcggtggcttcctcagcaaggatctctgcattggtgagcagtagtaggccgttatcgaaaccaaagcgggcaaggccttcagttgcttgaccattgagttcttttaaagaccatgtccatacccaacgcgtgccgtcgataacagcaagggggatggcgtgaacttggtgttcgtttgccacggtcgccacgttggtgtgtgggtcaaaggtgacgttgtgagacgaggagatggcgtcgaaaagcaattgatgctcagcggacatgaacgccgcatccgcgcgtacgtcgcgcaagctcagcccgcctgcgatttcgatgactttgccgccacgaagcaacagcgaggtgccatcgctgaaggagatgcggttgtcatcgaatcggatgcccagttcgcagaatgcagcaaatgaagtcaatgcccgtttgaggtcagttccaggcttcagcgcctgcaggccttcgatgagcgtgcgacggataccaaccagttttggcgtgtgattgatcgcaaccaacgccctgcgaccatcgcgcaacggggcgatgaacgccggcgcattgctatacagcgtgcgtgcggcggtgatcagatcatcgtcgagcggctgaatgccctgcaattcaggcagtcccaaatcctcaccgcgcgtgctgacccactcaaattcctgattattaatccacgcaatgacttcaccggtggtatcaaaaggactccccgacgccttattgatcctcacttcagccgcggttttatcgtcagaaaggttgaattcgactccagtaactcgccccaattgggcagcaaatgcctgatcaatgcaggtttggccgagggcaccatcagtgatgacatcgataagggatgtgggcagcggaatttccatacctttaaggatatgcaccgggggaaactatggggattttgggggaggttgttacaaaaccatacgtctgtgaagatatgacgagtgcatgcccaaaataatgcataggaaaaaggaagagttaacaatgcgtaaaggaatttcccgcgtcctctcggtagcggttgctagttctattggattcggttcggtgttgtctggaaccggcatcgcagcagctcaagactctgcatttgactacggtatggatccgagcatgaactacaacccgatcgacgacatcaaggatcgtccccaagggttatccaaccttccctacttcggaagcaaactaaccagctggggctcatcagatgccaccgcctcatccggcatcgtcacctccgcactcccgcaatacaccgacccacgctaccccctcggcaaagacgacctgcccaaagcaaccatcgacatggagccagaagctcttgcgcgccttgagcgattcgtcggcgttgacggtgatcgcatccgccaaatcaacgcgtactcgccatcaatgggacgcaccattcctctagtctgggtcgtgccagaagacaacaccgtgcctggcccaacggtctacgcactcggcggcggcgacggtggccaaggcggccaaaactgggtcacccgcaccgaccttgatgagttgaccagtgaaaacaacatcaacctcatcatgcccatgctcggatcttttagtttctacgctgactgggcaggcgaaagcgaatccatgggtggtgcgcaacagtgggaaacattcctcatgcacgaactacccgagccgctagaagcggccatcggcgcagacgggcaacgcagcatcgtcggcatgtccatgtccgggggatcggtgctgaactttgcgacgcatgaccccaacttttattcctctgtcggctcattttctggatgtgccgaaaccaactcctggatggggcgccgtggcatcgcagccactgcctacaacggcaatgtcgtgcctgagcaaatctttggtgaagtagacagtgattactctcgctataacgatcctttgctcaacgctgcgaagctcgaagaacaagacaacctctacatcttcgccggttccggtgtgttctctgaactagatgtcatcggtgacaacgcaccgattgatgaggatgcgttcaaaaaccgcgtcttggttgggtttgaaatcgaagctatgtccaacacctgcacccataacctcaaggctgcgaccgatcaaatgggcatcgacaacatcaactacgatttccgaccaaccggaacccacgcctgggattactggaacgaagcgctccaccgcttcttcccgttgatgatgcagggcttcggcctcgacggtggtcccatcccgatctataaccctaacggtgtgacctccagcgagtcttcctcagaactgtcttctgatgtgagccttggcaccgtgatcggtagtgtggcgggaagctccggatcaagtgcaggcagcagcgtccgagagttcattgcaggaagttccggatcaagccaatcagcaggaagcttctacgaataaaaaattgtggtgtgtgaatcttggggggaggtttgggggaggttcacacgccacaatttttatttcttaatccaggcgcatgcccgacggatcaatgcgactccatcttctatgtcccggggctcggaagcttggtaaaacgtatgcagcgaggttgcaattgccgctgcatgcaaatggatcagagttgccgcatcgaacttgtcaaggtctttgtcacgttcaaccatgaactcaagcaacggagcaatgagtcgctccttatcgataacacacttgatggggtcaagattttcaaggatctcaccgattcgaaacattgcgctgaaagaatccatagcgtcatcgccatcccgcaattggtttatcaccaattgttcaatggcatctcgtgggggcacgcttgtaggaaactcgtatagctgatccgtgagttcctgaacgcgaatgaccacaaattgcaccaatgcgtcttcccgagaagggaagtagttatgaaaagtcctgggggagaccccggctgcagctgcaatggccgcaaccgtgaacgcctcagggccttccatcaaggcgatctccgcagcagcacgtgacaatgctgtccgcgtagcagccttttttgtttctctaagccccgacacctacattttccttcagttcctcggtgcgagcctcatgtagttcactaagaccctcaccttcaacatcaacgttgggaagaatcttatccaaccacttaggtagccaccaagccttgtcatcaagcaggaacattgttgcagggataatcatcatgcgaacaacgaaggcatcgaagaacacagcaacggccagagcaaagcccatggtcttaataaacgccatgtcctgcgctatgaatgccgcgaacacagacaccatgatcagcgccgcagcagtgaccacgcgggcaccgtgcttgaaaccattcgacgttgcgttgcccgcagtcttgcccttggtgaagccctcacgcatacgagtaacgaggaagatctggtaatccatggccagaccaaataccaggccgatgagcatgatcggcaagaaggacagcagtggctgaggatcgtcgatgatgccgaaagcaccttcttggaagatcgccacggtagcaccaaaggtagccagaactgacaagccaaagcccagagccgcgatcaatgggacccaaatggaccggaacacgagcaacagcacgaggaacgctagaaccaaaacgatcagaacgtaaggaaccaggacgtcgccgaggcgagcagagatgtcatcgtaaattggggtgacgccagtaatgccatacgtcgcgccggtgtcatcagcgaaggtctcagcatctgcacgaagagttgcgagagtctcagaggtgcgctcatcgatcgcatcaaattctggggtaatcaggatctgcgcggtatcgaaattctccgtggtctgagtgatctgagcattcttcacaccatcagtgttcaagaattgctccaccgcctgtccaaacaccaatgggcgttcttcctcagggacgtcggttgcgtcgataagcgcaatcatgggcgcgttgcggcccgggccgaacgcatctgccgtcatgtcatacgccgtgcgcggcgcggtgcccagcgtggaggtgccatcagtcggcatggccaggcgcatattggtcgcaggaattgcgattgcaccaagcaaaacgacgccaaccagcaggtaagccaccggcatcttgcgcacaaggcggacccacttcagacccatcgttggcttctcgtcctcaggatccggaaccttaggtccaggcacgcgtgctgcgaagatgcgagtgccaagcaggccaagcagagctgggaggaaggacagagcaaccagaactgcgatggcaacggtgattgcggcagcaatggccatcacggttagaaatggaatattaatgatcgacagagcaaccagagcgatcagcaccgtggtacccgcgaatacaaccgcagaacccgcagtgcccacagccattcccatcgcatgcgcacgagcagccaacggcatggtgcgcagacgctcagccaattcctttggctccagatcattagcgccagtctgagaaatcaactcattgcggaaacgggacacgataaatagcgcgtagtcgataccgacagccagaccaatcatcgacgccagggtaggagtcatgtcattgaccgaatcagtaaacgccgtggctaactgaatgcccatgatgccgattccgacaccaatgattgcagagatcagcggcataccggcagcgatgaacgaaccgaaggtcacgataagaacgaccgcagccaccagcaggccgatgagctcagaggtcatgtccaagctggttgcagctgcgccaaacacgttgccgttgtagacaacagtcagatcgccgtcatcgtattcatcaagaatattggtgaccttctcacgatcctctgcggatatatccatggcagaatctgcatcaaaagtcatcgagatgatgccggtagtctcatctgcactcagtggactaatcgactcaatatctgcggcgatcttctccgcaggtacaccctgagcctccagggctggggtcatctgagcagccacaccctgcgcagccaacacaggatccacaacggaatcagcatccttcagcacaccagtcgcccgaacctcatcaagcatctggtttacttcagccccaacctcaggatcagtgagggtcttgccttccggtgcctgaatgacgacagaaccagtgggagccgatgttgcatcatccgaaccagggaaacgctcctgcatcttctccatggtcgtgacagaatcaagaccagggatagagaagctactcgacgttggcttggcatacagccccgccagcgtcgtgatacctatgagaatcacgagccagaccgcaagaaacggccatttcttttgataggccgtggagcctaacttatacaggaatttcgccacgattatcctttaatctaggagttgactgttcttctgggctttccaattattcggacggagtccctttaggaatttttcagcctgaatgcaattttgcacaacgagcgcaagtttagctttgggtgtggtgttgattaaagttcgaagactaatttgtgggcaatctggttttttcgtaattgtgtgggatgaatctcttaaaaattcacatttagcaggacaagcatactgttttagttctatgctgtgggcatgactcaaagtgctccagaattcattgccaccgcagacctcgtagacatcatcggcgacaacgcgcaatcatgcgacactcagtttcaaaaccttggaggtgccacagaattccacggaataataaccaccgtgaaatgcttccaagacaacgccctcctgaaatccatcctgagcgaggataatcctgggggagtgctggttatcgatggcgacgcatccgtgcacaccgcgctagttggcgacatcattgcaggacttggaaaagatcatggttggtccggagtaattgtcaacggagcaattcgagactccgcagtcatcggcaccatgacctttggttgtaaagcccttggaaccaacccgcggaaatccactaaaactggttccggcgaacgagacgtagtggtatcgattggtggcattgacttcattcctggtcattacgtctacgcggactctgacggaattatcgtcaccgaggcgccaattaagcagtaatttgttttgacgacgcagtaacgcaatcggggattgtggtcgattctttaagcaagggtaatgtcgaaacatctaggcaacccgacttttatgtccctgcttgagttgaaaactgctgtcgatcaaaggtgccccaattgtttcatgccgtgagttttgcattaatggactccgtaaatgtcctgctcattggcataatcgtcgcgattgctgctttgctgcctcgcaagggtaaatatgggccaatcgccacgctactggttgccggcgattggcttggcgttttcctcctcagtattttggtgatgctcgtttttgatggactagaggatttagttcagggctttttggattcaatctggttcggagtcatccttcttgtaactggcatcgtttccttcgttgcgacactggtttctaaaaccgacagcactagaaagcttgatggattcctagcgccagtaaaaactcctagttggaaaactgttggagccggattgatccttggaatcgttcagtcagcgacatctgtacctttttatgcagggcttggatatttgagcgttggcaatttcagtccagaaattaggtatggcggacttgtggtctatgcgaccttggctctgagtctgccgattatcgtggcaattctcgttggaatggttcgcaaataccctgaaagtcctgttggtaggttgtttgaactgattggtcaaaataaagagagagtcaccaaatggtcgggctatctcgtgtcactggttctgtgcataatgggcattacttcgatcctgtaactagcgcatgtactcatgagtcactagtagccaactattgattcgaaggtcagcttccctcgaggaaattcctttgtggaagtcttgatacatgctcgaggattcttcgagtggctggaaatgcgggtaatagtcttcatgcttcacagttaaaagaactggcgtcccataagagtcttcgaggcctgggaatttgcttgccaagaatcctgggatgcgaacctttttcatcacattgcgataattcagatatgtcatgaggtcagagtgttccacctcaacccaacctccataatcgagcttcttcttacctccatcgatggggatttcgatgtttgatttgatgaaatgacgcttcggtttcgggttcaaaatttggcacaccgatgatcctgtagaaactcgatgtccgcgcgattgagcctctataacggggtcggggagcttgaggttaagtgcaggtgctccgaagtgtgcaacgccgcagtgttcgcactagaaatggccaggtttcatgatttctccttaaatttagagtgtgagacacccataggctaggagagaatgggggagagtggcgctttgaggtgcctgccgttgtggataaccattttgaggtacgcgttacctgtggataactctctttgacctggaagattggagagatttagggaaggattgggcgtaactctagtgtgatcagcttttgaataagtgtttgaatatcacccttgcgttcgaaagtgtgagcgggtaaggtgggtgataacaacgcggggaatagatcaacgggaaagggggaagacaccatgagcatcaccacacacgtccaagcactcaccacagcactcaacgccatcgacaaccatttggccagcatgcttgaccatggtgtcaccccagaccaatacaaggccatcgagcccgacctcatcgccctagaacacaccatcaaccaccacgccaccatcgccgcccaaaccaccgccctcgccgaacgcaccaatgctgcgcagtcgattggctccacccacctcatcgactacctcaccaccaccttcggcctatctaaagcacgcgcccaccaccgcatcaatctcgcccactccctctaccccataccgaagccaaactctggatctggcaacggcggtaatggtggcaatcccgacggtggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactgcgcaaccaagccctgagtcaggcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgcggcaacctcgtggatctaccagcagcagaagatatgcgcacccgagggcaacgccatgcggacgcgttgcatcacatcatggagatctacaaccacggtattgtcaccccagctcgtggtggaacagccagcatcatcatctccatgaccaccgatgatcttgacgagatcaaccacgccaacagcagtggtgaaagtctgcttaacaacctgtaccccaccaatacgggttactcattgaacttggcggagatcatgaacctcatcgctgcgaaatacgacttcgctgtgctcctcgatggtgagacggggcagccgttgaacgtcaatcggatgcagcgctcagcgaacctgactcaacgcatcgcgttgtttgcttctgagttggtgtgctcggcacccaattgtgatcggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcctgctactggaagagtggggcactacccagtgggtggtgaggggccggtgtttaaccggtcggctgctgctgatcgttccggtggtgcgtgggcgaggcgtaagcatcatggcccgccacccacaccgccggacccgccggatccgcctggtcctgagccggatcctggtgatgagggcagattgttctagctcttgttattgctgagttgttgtcatgttgctgtgcctgttgtcagtcgccccagtgtgtctaataccgggcacacccatgccttgcatcaacataccgacaagccagcacaccccgaactggccagccgggcccgggccacctggaacctgacgtcgacaagcaaaaatcccaagcagcccaagccaccaaagccgcccagttaattactcagctaccagcgactccagcacgaaatcagggtgctccttctcgatgaaggataggcgccacttgtcgctgaacagtgcaatcagttcgccgtcggtgcgggtgaagatttccacgccgcgctgcttcgccagttccggtgcggtttcggcggtggtgcggcgggcgacggagtatggaatcggatcggcgacggtttcgacgttgtattcgacttccatgcgggcttgcatcacttcgaactgcattgggccgacagcggccatgactgggttggcgtcgccacgcaggtcgttcttgaggatctggacgacaccttcggagtccagctgctcgagggctttgcggaactgtttgtatttgccgagtgatttggcgcgcaggatgcggaagtgttctggcgcgaattttggcattggtgggtattggatttttcggccttcgaagatggtgtcgcctggtgcgagggcgccggcgttgacgaggccgacgatgtcgccggggaaggcggtttcgacggtagagcgggtgcggccgaagacggtgagggcgtatttggtggagaagctgcggccggattgggagtgggtgacttgcatgccgcggtcgaattcgccggagacgacgcgcatgaaggcgagggtatcgcggtggtttttgtccatgccggcttggactttgaagacgacgccggagaagtcgtcggtggtgtcgcggtggtcgtccattgcggaggtggcggcttcgagggctttggggtctgcgtcgcggccggcgggggatggtgcgagttggcagagggtgtccaggatttggtggacgccgaagttgagcatcgcggaggcgaagatcagtggggaggtggtgcagttgaggaagagttcctggtcgtggacggcgccgtcggctgcgaggagttctgcttcttcggtggcgttttcccagacgtcgccttcgcgttcgatggcttcttctggggtgtagaagtcttcgggggcaatggtggagccgccggcggtgcgggtgaagtggatgtattcttcgacttcgccgtcgttgttgatgcgggctaggccgcggaagtcgccggcttcaccgactggccagaacagtggggtcggttggagttcgatttctttgacgatttcgtcgacgagctcgagtggggtgcggccgacgcggtcccatttgttgatcacggtgatgattggcaggccgcgggctttgcagacgcggaagagctggagggtttggggttcgaggcctttggcggcgtcgataagcatgactgctgcgtcgacggccatgaggacgcggtaggtgtcttcggagaagtcggcgtggcctggggtgtccacgaggttgatcatgaagggctcgcctgcgtggccttctggtgcgtactcgaattggagtgcggaggaggcgatggagatgccgcggtctttttccatttccatccagtcggaaacggtggctttgcggcctgctttgccgtgggtggcgccggcttcggagatgatgtgtgcatgcagcgccaatgcctcggtgagggtggatttaccggcgtcggggtgtgcgattacggcgaatgttctgcggcgatgtgcctcggcggcggtggtgtcgggattggcgttgctcatgggtattaagaatagcgggttgtgggcgctgggccatagtcgccccagctcagcgaagttgtacgccggcgttgcctgcttgtcgacgttttttgccacttcccttaattcgggggtggctgaaatgtaagacacgtcactacatttaagctcaaaaacaactacctataggctgacagaaactctaaaaactatagagctatagaaactttaacttcggaggtattcatgtcccgtccaatcgttaaacaagcattcaccgtcaccgcagtcaccgcgatggcttttgccctggcatcatgcacccgcgcagtggatgcaacctccgcagatggaaccgcgagcaacaccgcagcttcctgtgtggatacatccggcgactccatcaaaatcggcttcatcaactccctgtccggcacgatggctatctctgaaaccacggtgaaccaatccctgcacatggcagccgatgaaatcaacgcagccggcggcgttttgggcaagcagttggagatctctgaagaagacggcgccagcgaacccgccaccttcgccgaacgctcccaacgcctcatccagcaggaatgcgttgcagccgtgtttggtggatggacctccgcctcccgcaaagcaatgctccccgtctttgagggcaataactccctgctgttctacccggtgcagtacgagggcatggaatcctcgccgaatattttctacaccggcgccaccaccaaccagcagatcatcccggctcttgattacctgcgtgaaaacggcctgaaccgccttttccttgtcggttccgattatgttttcccacgcactgcaaattccatcatcaaggactacgccgaagccaatggtatggaaatcgtcggcgaagactacgcgccgttgggatccaccgacttcaccaccatcgccaaccgcatgcgtgactccaacgcagatgccgtgttcaacactttgaatggcgattccaacgtggcgttcttccgccagtacaacagcctcggcttcaatgcagacacccttccggtgatgtcagtatccattgcggaagaagaagtcggaggcatcggcaccgcaaatattgagggccagctggtggcgtgggactactaccaaaccatcgacaccccagaaaacgagaccttcgtggagaatttcaaggacctctacggccaggacaaagtgacctccgatccgatggaagctgcttacactagcctctacctctggaaagaaatggtagagaaggccgattcctttgatgtcgccgcaattcaagcagccgccgacggaaccacttttgatgcaccagaaggaaccgtggtggttgacggcgataaccaccacatctccaaaacaccgcgcatcggtcgaatccgcccggatggattgatcgacaccatttgggaaaccgattccccagttgatccggacccatacttgtcttcctatgactgggccaagaccaccgctgcgacttcctaagagataaaaatcatggacattttactcaatcagctcgtagccgggctttcagttggatcggtccttctattggtcgcagtgggattgtcactgacctttggacagatgggcgttattaatatggcgcacggagagttcatcatggtcggcgcatacaccgcatatgtggtgcagctggtcgtcggttctgccggtttatccctactgatcagcattccgctggcctttattatcggtgggcttttcggagttctcctcgaacaattcctgctgaagtatctttatcacaggccactagacacgctgctggccacattcggtgtcggtttgatccttcagcagctggcccgaaacattttcggagctcccgcagtggatgtcagggcaccggaatttctccgcggaaacgtcgaagttctaggcgtcttggtgccgaccgcgcgactattcatcctggcgctggccatcgcatcagtgactgcactagctgtgttcctaaatcgcactgcctggggccgacgcatccgcgccgtggttctgaaccgcgacctcgcggaaaccgcaggtattgatacccgagctactgaccgaatgacgttctttgtgggctccggtcttgccggaatcgccggggtagctatcacattgattggcgcgaccggccccaccatcggtcagaactacatcgtggatgccttccttgttgttgccgccggtggcatcggccgggtgaagggcgctgtgatcatggctttcgtgctgggaattactcaagcattcgtggaatatacgacaggtgcgagcatcgcgaagttcatcgtactcatcgctgttgttgccttcctgcagtttaggcctcaaggactcttccaaacccaaactaggagcctcgtatgagcactcaactcaagctgaagaagcccgcaaagaagaaaactacgccgaaacttagcgtcgtaaatgctcccacgctgcgcactgcggcgttgggcctggccgcgctcgctgcggtattgctgtgcgccccgctctttttatccacattccagctgacgttgatgtcgcgcttggtgtgttatgcgatcgtcgcagtcggcatcgggctggcgtggggcagaggcggcatgctcacgctggggcaaggcgtgttctttggaatcggcgcgtacatcatggccatgcacatgctgtacagcgattcgcagatttttgggaccacagttccgcaatggtggtccatttttgccaacccggcagtcgcactcatcgcagttgtggcgcttcccggcatcgtggcttttgtgctcggcttctccattttcaaacgacgcatcaaaggcgcctactttgccatcgtgaaccaagcgctcgccgcagctgttgtggtgttgctggtcggacaacaagattcccttggaggttccaatggtctttccggatttcgatcgttcatgggttttgccgtctacgaccccatcaaccgcatcatgttttacttcaccgcagtgggagttctcttggctttggtggctatctcatattggctcatgcgcagccgctatggagaactgctcgtggccaccagagatgcagaagaacgcgtccgattcctcggatatgatcccgcattgatcaaaaccgccgcatatgtcattgctgcgatgattgccggaatcgccggagcgctgttcgtgccgatcgtgggcatcatttcacccgcagaaatcggcgtggtgccatcaatcgtgttcgtgatcgccgtcgccgctggtggcagggcatccctattcggtcccgtagttggcgcgctggtgctgggctgggtggaatccacacttgctcaaactttccccagcatgtggtcctatttccagggtgcgatcctggttctcgtgatcgtgttgctgccgggcggaattgcttcaattaaactttccgcgctcaaaaataaggccaggaaggccacctcatgagccttaaaatcaccaacctcaaagtcgctttcgggtcgttcatcgccgtgaatgagattagttttcaggtgctgcccggtcacgtccacttcctcatcggtgccaacggtgcaggtaaaaccacctgcattgacgcgatcagcggattggcgccggggcagggatcagtgcagttggatggcactgagattctgggaacccctgtgcaccgcattgctcggatgggtgtggggcgaacgtttcagaccgccagcgtgtttgaagaattgtctgtgttgcagaatctggatattgcgtgcgggattcatcgtccgttgcgggcgcttctcggggtgcgtcatcggattgatccccgaattgaacacgccctggaggtcacgggtcttgctgatctggtgaatgctcaggcgggaaccttgtcgcatgggcagaaacagtggctggaaattgcaatgttgctggtgcaggatgcgcaggtgctcatgctggatgagccggtggcgggcatgagtgaggaggagcgtgtcgcaacgggtgagcttttgcagagggttgcgcggggacgggtggtgttggtggtggagcacgatatggagttcatgcgtcgttttgccactcgcgtcactgtgatgaatcgcggcacgatcttgtgtgaggggtcggtcgatgagattcaggcgaatccggatgtgcagtccatttatttaggtacggcagggaagtgagttagtcatgttggaaatcactaatttgtgtgcaggttatggccgcacgcaggtacttcattctctttcaatctccacgagcagcaacggcatcctgtcgatcctcggccacaatggcgctggtaaatccaccttgctgcgaaccgcggtggggttgattaagccgacttccggagaggtcaaacttttcggccaggatgtcacctcgttgtccacgcatgagcgagtaaagcgcggaatggcttatgtgccgcagggccagcagtcttttacgcagcttagttgcatggaaaatttgcaggtggtagcggatctgcagggacgtgtgggcaaggcacgcatcgcggaggcgcttgatcgctttccggcgctgacccaggtgctggaccgccaagccggcctgttgtcgggtggtcagcgtcagcagcttgccatcgcccgcgcgctgatcacggcgccaaagcttttgcttctcgacgaacccaccgagggtattcagccttcggtggttgctgaaattcagcagaccatcatcgatttggctaaggacggcatgagcattgtcctggtggagcaaaacattggttttgcattggatgctgcaacaagctacgccattgtggcgcgtggtcaggtcgtggaatcgggacaaggcgctgaaaccaccgcagagaagcagactaaagtgcgggaatctctagcaatctagcggctgtggatagcgttttgcgcagcagataatccctgggccagcagcaaatccactgcctcggcggcaagttcaatgcctggttggtcgtgatcgactggttccaaaacgtagtcgggcacggccattcctgctggtggtcgtgaaatgccgatgcggacgcgcaggtagtctctggtgccgagctcttccgtgagggatttcaggccgttgtgaccgttttcgtttccgccctttttcaggcgtacttttccagcgggcagatcgagctcgtcgtggatcacgatgatgcgctctgctgggatacccaacgctgcggcgatcggtgcgacaccttggccggagtggttcataaaagtggtggatcgaacggcgagcacccctggtgcgagctgcgttgtgagggccttgtagcccgtggcgggggtgaggggctgctgctggtgggcgtcgataagcatgtcttggcacatgtaaccgacgttgtgtcgggtggattcgtacttggcgccggggttgcccaggcccacgaccagccatttggcggcgggaagttcaggcttgggggcaaacagtgcttggattttagacaaaaaactcacggaagtcatcctatggcaggcgcgcctaggatggtgccatgagcatccttgacacgttgaaaactcccgtgattgtcgccccgatggctggcggcccgtccactcccgcgttggtcaatgcagcagcagaggcaggttccctcgggttcttggctggtggcgtcatgcctcttgagcagctgaaacaggaattgtcagaggtaaaaggcgtctttggcgtcaacctgtttcgcccgcagacggatgcgcctaagccttcagacattgatgagctggcgggattgttgtcctcggcgtttcggcaatttggcctcgatgagccgacggtgcctacgccggatttgagcaatgggtgggaggctaaatttgaggccgttcttgccgctaagcccgccgttttttcctgcacctttggtatttttagcgctgaagaattcgcccggatcaaagccaccggaattgaggcgtgggtgacggtgaccaatccggaggacgcgctggctgcgcagaaagctggcgccaacgcgcttgtcgtgcaaggccccgaggcgggtgggcaccgctctacctggtccattgaagtggagccggacgagcgcgacctgaaaaccctcctcgcagctgtcaaacaagcgggcgtttacctcccgctcatcgcagccggcggcctttcaacctccgcagacgtggcagcaattttagaagccggcgccagcgctgcctcctgtggttccgcctttttgcttagcgacgaagccggcaccagctcacttaaccgcgagatcttggacgccgccccagcacttggtttggaatcggtgtcatctcgcgcattttcgggccgttatgccaggggagtggaaaccaggttcacccgttcgaacgaggggttacccccgttgtacccatacctcaacccaatgatcacatctttacgtaaggtggcgggaagtgcagggaactgggattacgcctactgcctggtaggagtcggcctggaatcgattgcgaagggtagtgcaaagcagatactggaatcattaacaccttccgctttgggctaatgttggggggagtgctttcaactatccacgagagctgcccagtgataaaccccgggttaaccccacgcctaagtcagtgaaggactttttatgacgcacaaccacaaggactggaacgatcgcattgcagttgcggaggaaatggtgccgttgatcgggcgcctgcaccgcaacaacaacgtggtggtttccgtattcggtcgtctccttgtgaatgtctcagacatcgatatcatcaagtctcaccgctacgcccgccacatcatatccaaggaacttccactggaaagctccttggatattttgcgcgaactggtagatatgaaccttggtaccgcatcgatcgacctgggacagctggcctacagcttcgaagaatccgaaagcaccgacctgcgtgccttcctggaggacgctctcgcgccggtcattggtgcggaaaccgacatcaacccaactgatatcgtgctgtacggtttcggccgcatcggtcgcctgctggcccgcatcctggtttcccgcgaggcactgtatgacggtgctcgtctgcgcgccatcgtggtccgcaaaaatggtgaagaagacctggtcaagcgcgcatccttgctgcgtcgtgattctgtccacggtggattcgatggcaccatcaccaccgattatgacaacaacatcatctgggccaacggcaccccaatcaaggtcatctactccaatgacccagccaccattgattacaccgaatacggcatcaatgacgccgtcgtggtagacaacaccggccgctggcgtgaccgcgaaggcctgtcccagcacctcaagtccaagggcgttgccaaggttgtactcaccgcgccgggcaagggcgatctgaagaacatcgtgtacggcatcaaccacaccgacatcaccgcagatgatcagatcgtttccgcagcatcatgcaccaccaatgccattaccccagtgctcaaggtgatcaatgatcgctacggcgtggaattcggccacgtagaaaccgttcactccttcaccaatgaccagaacctgatcgacaacttccacaagggttctcgccgtggtcgcgcagcaggtctgaatatggttctcaccgaaaccggcgctgcaaaggctgtatccaaggcgcttccagagctggaaggcaagctcaccggcaatgccatccgcgttcctacccctgacgtgtccatggctgtgctcaacttgaccctgaacacggaggtggaccgcgatgaggtcaacgagttcctccgccgtgtgtccctgcactctgacttgcgccagcaaatcgactggatccgttccccagaggttgtttccactgacttcgtgggcaccacccacgcgggcatcgttgatggtctagccaccatcgcaaccggtcgccacctggtgctttacgtgtggtacgacaacgagttcggctactccaaccaggtcattcgcatcgtcgaggagatcgccggcgtgcgtcctcgcgtgtacccggagcgcaggcagccagccgtactataggttatccaagcctaatacactacgattaggcatatgagtaagcgtaagtcacgggtgaaagttacccacaatccattgggcatgaaagtcaaagacacgtgctgtcgcaaaacgccgcgctgcaccaactgcccagtggtgtacacacgcttactcaaatccggggtcttagaaaacgacgacgccgacctgccgcgccgcctcaaagaggcgcggcgcaagtagctagccctgctgcaaatgcttttcgacgagatctgcagcgtcagccgccatgatgggaatatccgccagttcttgcttgccaaaaggcttcaacacaaaacttgccggatccatccgacccggtggcctaccgatacccatgctgagcttccaatagtccttagttcccaaagatttggacgtggatttcagaccattgtgcccatgatccccgccaccctgacgtagcttcactgagccgaaatcaagctccaattcatcatgcaccacgatgacattggctggggaaatcttaaagaagtcacacagcgcccgaatcggagttcccgacaggttcataaagctgcgcggcttggccacaattagcccaggaagctgcgcgatatcggtgttggagcgcttgtgcacactaaatgatccaaagctgcgcgacactagttcttctgcaacctcaaagccaatattgtggcgggtgccaacgtatttcgggccgggatttcccaggccaacaactaaaaggggagagttattcacatcccccatccaaccatgagtccaccacaagcaaaaacaggccccgccaccatgtgaggaaacctccatgatgatcgtgcactgtcatcactttaaatttccccgcacggcaacgaggcccgcgaaagataaagctatctaaaaaagcttactcagtagctgcttcttcagctgcttcgtcctcttcggtgtcttcttcctcgacagctgggagaacgatgttgacgatgagggtctcaggatcctcaaccagggtggtgtcgccctcgagcttgatgtcagctgcggtgatctgtgcgccgagctcaaggccttcgatggaaacggtgaactcttcagggatggacagaacgtcagcctcaaccttgatggtgtcagcatcctgaacccacatggtgcctggagctggctcgccctcgacgataactggaacgtcaacctcaaccttttcgccgcgcttaatggcaagcaggtccaagtggtcgatgtggaaggtcagcacgttctggtcgatgtgcttgatcatggtgagctgcttctggccctcgatgtcgagctcaagaacagcgtttacgccttcctggcgaaccagcgcagcgaaggtgcggtggtcgatggtgacgtgcaggttggactcaacatctgcgccgtaaacaacagcagggatctggccagcaacgcgtgcacgacgtgcagagcccttgccgaactcagagcggacagcagcctcaatggtttggtactttgccatagtgatttctcctcatggatgaaggtggacactcggccgcgaaaataaaaaatgcccgcgaccgactcgaatgtcttggtcgagtcttcgcaggcagcgcacaaaagtgcactttagaagtctagatcgcgtcgataacggttgagcactagaagtacttgaccctcgccgagacctaaatatgctagcacgatggccaaacctaatccaaaaaccggcagtatactgattggggtcacattagccaaaaggcactttgaggaagtggaactcctatggcacgacttcagcacgacatgattttcatcaacctaccagtatctgaccttgcagcatctaagcgtttttatgcaggtcttggcttcaaagaaaacaccgtcttcagtgatgagcacactgcatcttttgaggtcagtgacgccatcgtggtgatgcttctggaaaccgcgcgcttcagtgatttcactaagcgccccatcgtggagaagaacggctcccgcgaagtgctcaactgcctgtctgtatgttccaccgaggatgcggatgagttcgtgcgtcgcgcccaggaattcggaggcacgatcacccgtgagcttgcagcggaaggccccatgtacggcggagcttttgatgatccagatggacacggttgggagctgatgtacttcgatccagaggcactcgctcagatgatgcctgagggctaaatattcttcagggcttctcgccggctcagtggggaaaggtccgtggcgtcgacaaaagcccggacccagctggggtcgtggcgggcgaaatcccgcagtgcccagccgatcgctttgttgatgaagaactcgctggagccgaggttctgctcgatgatccaggccagcagggcagcgtcggtgtttttcttgcggcccagttggtggatgatcgcgatgcggcgcacccagaagtcctcatcaagcgcccacgttttcatcagatcatcatcgtgtttggcgccgatcggttttgctagggaatcgacggtgtcccaccaggatttggtctgcactaatgctttggcaaaacctagatcggtgatgccgacgcgattgatgtgatcgcaggcgacatactggtattcccgttcagctgcgccaaagcagtctgagacaaagtcagtgtccaactcttttagcgcggacagcacgggtttgcaggcttcttttctgggggtggatgggatgccgagaaaagaaaactgatcccgcatgtagcttgccattccggtggcacgtgcgggatcagctagaggttccaatgccaaccggacgcggttgaagacgtccgtggtgggcatgggtgtttaggcctcgccctcgaagagggtggtgacggaaccgttttcgaagatctcgttgatggtgcgagccagcagcggtgcgatcgacaaaacggtcaggttgctccagccctcggtggactgtggcagggtgtcggtggtgatgacttcttcagcaccgcatgcagacaggcgctcgcgggctgggtcagagaacacaccgtgggtgcaggcgatgacgactgactttgcgccagccttcttcaggacgcccacagcgccggcgatggtgccgccagtgtcgatcatgtcgtcgagaagcacgcagtccttgccgtcgacgtcaccgacgacgcggttggcgacaacctggtttgctacctcggtggagcgggtcttgtgcacgaacgccattggggcatcgcccaaggtgttagcccacttctctgcaaccttcacgcgacctgcgtcaggggagaccacgcagatgttgtccaggttgtagttttccttgatgtgatcggtgaggatcggcatggcgtgcatgtgatcgactgggccgtcgaagaagccctggatctgatcggtgtgcaagtccacggacacgatacggtccgcgccagcggtgagcatgaggtcggcgatgaggcgagcagaaattggctcgcggccgcggtgcttcttgtcctggcgggcatatgggtagaacggcaggatcgcggtgatgcgctttgcggaaccacgcttcaaagcgtcgatcatcagcagctgttccatgagccacttgttgagaggctgggtgtgggactgcaggacgaagcagtcggagccacgaactgattcctcgaagcggacgtagatttcaccgttggcgaaatcgcgtgccgtcattggggtgacgttgacgtcgagctctttagctacagcttctgccagttctgggtgcgcacgacccgaaaacagcatgaggttcttttggttttgtttccagtgagcagtcatgaggatcctgcttagccttcctggttgtggacgttttgggcggcttctgcggcttgtgctgcagcggttccagggcgcttcttttgcacccagccttcgatgtttcgttggcgtccgccggacacggcaagggctcctggcggaacatcgtctttaattactgtaccggctccggaatacgctccgtcacccacggtcactggagcgataaacatggtgtcagaaccagtgcgaacgtggctgccgatggtggtgtggtgcttgttttcaccgtcgtagttcacgaagacagaggaggctccgatgttggattcctcgccgatggtggcgtcgccgacataggtgaggtgtggaaccttggagccacggccgattgtggccttcttggtttctacgaagccaccgagcttgccttctggtcccagtgtggttcctgggcggatgtaggtgaaggggccaacggtggcgttttcaccgatggtggagtcgaaaccgtgggtgcggattacggatgcgccgtcgccgatggtcatgttggtcaaggtggtgtctggaccaacttcaacgcggtctccgatgacagtttcgcccttgagctgggtgccagggtggatgatcacgtcgcggccgatagaaacctccacatcgatccaggtggttgctggatcaacgatggttgcgccaccacgcatagcggcgatgacggtgcgacggtttagttcggcgccggcttctgcgagctgcacacgatcgttgacaccggcgagttcacgagcatcggcggcggtgtgggcgcgcactgggtggccctcgccacgagcaatgcccaatacgtcggtcaggtacagctcgccctgagcgttgtcggacttcagttcagccagtgcggaacgcaagatggcggcgtcgaaagcaaagacaccggagttgacctcatcgatggcttggacttctgctgaagcatctttttgctcaacgatggcggtgacttcgccttcttcgttgcgcacgatgcggccgtagccggtggggtcatccagacgcatggtcaacacggtgacagcggttggaacttccacgtgtgcatccagcagtgcagacagagtgtggtcggtgagcaggggaacatcgccgttggtgacaatgatcgtgccttcaaagccctcgagctgatccatggcgcactgcacagcgtgtcccgtgccattttgttcctcttggatagcgatgaggacttcccggtccagttcttctgcaacctgggcaacggctggacccacctggtcgcgtccatgtccaattactgcaacaatgtgctcgggattaagcccggcagctgcatgcaagctatgtgaaatgagactgcgtccaccgatgctatgcaacgttttttgtaagtctgatttcattcgggttccggcaccagctgccaaaacgacaactgcgctcgagaaatcgcttgcgctcaagattatctcaaatccttaaaagttcttgcggggcacttatacccaagcaagcataatgccccgaaccccaaaacctgcctatttgggtggaaaagttgtaaaactatccggcggatacttccttgaggccacgggcgctaatggttccaagcaggccaattgccgccaagaagagcagtgcggcttcgtttccgaaaattgcaatgaagccagataatgcgccaacaatgagcaaaactacacccattagtgtgttggcgtcggcaacatagcgggtgcgctgatcaccttcagccatgtccattacataagttttgcgggccacgcggatggcggtgtgggccaaggtgatgaggaagaaactcaacgggaacaccagcgtgttgatctgcgcgggtgcaaacgcggagctgagcaccacgaggattaacacgatggaaccgaatagggcaccgcccgccatgacgtttttggaggaatgatccgaccagattccagagattcggccaccaaccatggacgccaagccggaggcgatgaggaagaatcccaaggagtcgatgctgtttccggattcagcggcgagtgcgacgatgaaagccgtggagagtgctgtcaccagcatcattgagcgaaccagaacgaaacgtcgaaaagctttatcatcttttaatgcggcgatgcagcgacgcacccacgggtttgcggaaggcgcgttttttggagtcgctggcttcgcgtattcgatgcgcgcgaaaacaatggaggcaaacagccagctaaacgagctcgcgatcaccactgcggccagcaccctcgtcggggaatgcgagcccaagaaaatagcgatcgccaggcctgcaaccaggcccatcacaccgccaatcaccgtcgcgcggcccgttaccagcccacgcttgcccttggaaatcaccttgccctgaacatccttcgatgcaatcgaacacatcgatcgaaacagcgacagcgccgcaagcagcacgatcaccgtgatgcccagcgcccacccacgcaaaaacagcgcagccacgccgatacccagcgccgagacgaactggccgttcgagccaatcacccagactttgcttctcgacgtctgcctcagcacccagccagtaatggcagcttgcggcagcatcgatccggcttcgcggattggaaccagaagcgccagcaaaaagcccggcgcgccagcggcttgcagcaaccagggcaggactgttttggcggcaacgatttgatcgccgatgttttgcaggccgttggcccaaatgaggcggcgtgcgttgcgctcctctgtgggatttgtcatgggtgaaagcttagaagaactacaccgtttggttgatatgatgtggggtgtttatgaaaatttgtttgagggagtgaaggcgcatgttgttgccagagttgaatcgtcggacttttttcaaaggggccggggtgctggcagcaacggtggtgggtgcgcaggtgctggtggcgtgttcctcagatgatgtgcgtggttatgggggagagccgcggacgttgcctattccaccagcagatttaggtacgcgtgagggatctagcgtgcactttgccctggaggctcagactggggagagtcagattttgccggatgtcacaacgaagacgtggggtttcaatggcactcatttggggccgacgttggtggtgaagaaaggtgatgacgtccacgttgatgtgataaacaatttggatgaaatgaccactgtgcactggcatggcatgaagttgccggcgattgctgatggtggtccgcactcaccgatcgggcctgggcagacgtggtcaccaacgtggactgtggccaatgatgcagccactttgtggtaccacccgcacactcatggcctgacaggtttgcatgcgtaccgtggtttggcggggatgatcattgtggaagatgaagcaacagacaagctggatctgccacgcgagtacggtgtggacgatattccgctggttttaatggatcaccgcttcttagaagacggttcccttgatgaggaagacctccccgatcttgggctgttgggcgatacccccactgccaatggcattaccaatgcgcactttgatgccaccacgcgccgggttcggttccgcgtgctcaacggctccaatatgcggttctataacttggcgttttcagacacgcgcaccttccaagtcattgccagcgattccggtttgctggatgaacctcaagaccgcaccaccttggctattggcccaggcgagcggtgggaaatcgtcgtggagctagagcccggcgaggacgtcaccttggaatctgtaggttttgaggacaactacggcgtccctgatgatgagttcgtgcccgatttcggcatgtcagattccttccagctgctcaccatcaccggcccttccgatgatgctgcgcaagcacctgctttgccgggcgtgctggtgaaatccaccgaacctgacgtcatcgatgccactgaacgcaccttcatcatgaacaccttctccatcaacgatctacagatggacatgcagcgcgttgacgtggtgattgaccatgaccagccagaagtgtggattgtcaccaacgacaactccgactggccccacaacttccatgtccacgacgcccggtttaaggtgctgaaatttgaaggcaccgacgtagagctcttcaacgacggctggaaagacaccgtcggcctgccaccgggagcaaccgcaactttagccgtggaatttggccactacccagacccgcaatggccctacatgtatcactgccacatgctctaccacgaggatcaaggcatgatggggcagttcgtcatcgtggagccaggcgacgagccggcggcggtgctggggtcgggcacgggctccagcattgactccgccggcggacatgcgcactaggggcgtggggcggcgtcgataagcgagattttttagccctttagaagccacatgacatatgtcatgaaaattatgtgcaaagtgcagtaatactcctgacatatggctctaccagcgccaatgcgaagtaggaagaattatgcctatgacaacgacaccagcaatcgacgtaacagacctcgtgagaacctacggcgactacaccgcagtcaagggcctgaatttccatgtacagcgcggtgaagtatttggtctgctcggcaccaacggggccggcaaaacctccaccttggaagtcatcgaaggactttccgcacccagctccggcaccgtgcgcatctccgggcttgaccccgttgccgaccgcgcgatcctgcgccccgagctcggcatcatgctgcaatcaggcggcctgccatcacagctcaccgtcgccgaaaccatggacatgtggcacggcacctgcacgtatccgcgcgccattaaagatgtgcttgccgacgtcgacctcctacaccgcgaaaacgtcaaggtcggcgcgctttccggaggcgaacaacgacgccttgatttggcctgcgcactgcttggcgacccctcaattttgttcctcgacgaacccaccaccggcctcgacccagaatctaggcgccacacctggcaactcctgctggacctgaaacagcgcggcgtcaccatgatgctgaccacccactacctggaggaagccgaattcctctgcgaccggattgccatcatgaacgccggtgagatcgcagtggaaggcaccttggatgaactggtggcccgcgagaagtcgatcatcagtttcgtgctgcgtggcgggcaggtggagttgccggtcttgagtggggctgaaatcatccgcgacaacaaccacgtccgcatcgccaccaccaccctgcagcagcacaccttagaaatacttacctgggctgcagagaccgggatcgcgctggaaggcttcgctgcaaaacccgccaccttggaatccgtattcatggacatcgcctcactcgagaacacctcgctgcaaaccgcctagaatctttaaggagaccacaatgaccacgtcacacaccgcccgcggcctgcaacatgcaaccccggagcgccgcaagacttcatttttcaaaacctctctgtttaaggccgaatggctccagttccgcagaaataaaaccctgttgttcatggccaccgtattcccagtcggaatccctttgttgctctttctcatcggaaatggtggggcagcagagtccgcgaactccttcgactacttcgtcatgtacaccctgctatttgtgcagttctacacggtgctgtccatggcaaccacccgccgtgatgaacgtgtgctgaaaaggctgcgcacgggagaagcccgcgacatcgatatcatcggtgccatctgtttccccggcgcgctcctcacactgatcttcaccgtggtgatcattccattgctcatggttttgggagctcccgcgcccatcaaccttgtgcccattgtgtttgccgtactgatcggactacttctttgtagtgctcttgccttgatgaccagcggtttcacccgaaacgccgaagccgcacagatgacctccatgcccgtgttcatgcttgcgatgggtggacttggatcaatccgcttcgtattcggcgacagcattgtggctgatatcttggcctacaccccattcgccgcgatcagtgaccttgtccaaatcggctgggctggcgccaccttcgccgacagcgttggtggagtagaggcagcaaacttcgctggaattttccaagacatgctcataccacttggaattctggcagcgtggacagctgcagcggtgtgggcggcgaaccgctacatgcgctgggactcgtaccgctaagcctgcagccgacgggattaaggcagctaacattgagacacgatgaataaagatttctggaccgcaggctggaccgcccgctggttttcgcgcggggtttcccttttggccagcccagttaccgccccactgaactcttggcggagattgcctaacttggccaagtacaccctctacaccagggtgtcgttgcaagcgatccccgtggtgttgctgtcggcgtatttcctgggcatcgtagctaatgcaggcaccctgaatccctcatttgtgtggctgctgggtttctcggtcatccttttaatagtgacggtattggtttatgaatatcagccatcgctgaattctcatcctaggcgcagcgtacagccgttcttcttcaccgggttggtgctcaacgttttaggcgttgtggtgtctgtggtgcttcaaattccgggcttaaacatgtcggacaacacccgagcaactgcccttattttcactcttacctgcgtatttctgctttcgatcgcctacattccgtggatgaattaccgatgggtttggctgatcgcaatgtctgcagtgttgtggtggaccagcacaacgactgattatttaagtgcattgtgggtggttatcccgccactcatggcaggaaccgtccgactttccgtatggaccgtcgatgtcatgaaagaggttgagcgttcccgcgaattggaagcctccctccgcgtcaccgaagaacgccttcgtttcgcccaggaactccacgacactttaggacaacacctggcggcaatgtccgtgaaatcagaactggcgcttgccctggcgaaacgcggcgacgaccgcctcgaaaacgagctgcgtgagctccaaaaactcacccgcacctccatgtcggaaatgcgcgacgtcgtctccggctaccgcaccgtcaacctcgccacggaaatcgagggcgctaaaagtttgcttgccgacgcccacatccacctttccgtcatcggcaccacgtcccaggtgtcacccgctcaccgagaactgtgcgcgtggcttgtccgggaagccaccacaaacattctgcgccactctgatgcaacggatgccaccctcacgttgagcagcacagaggtgcgcatggacaacaatggtgtgaacaaggacatcggcagactctctggtctcagcgccctgcgctcacgagcggaatcagccggaatgacgctcattgtgtcccgcgaagacgaccagttcagcgtccgcatgctcattaatgcacctgcaaatacacctgcagaaaaggaagcttaaatgatttccatttccatcgccgacgacgaagccctgatcgcaagctccctggcaaccttgctcagcttggaacccgatttagacgtccgacctaccgcaggatccggtgaagaactcattgaaacgtgggcggatccaagcaaccgaaccgatgtatgcgtccttgaccttcaactcggaggcatcgacggcatcgacaccgccacccggctcatggaaaccaccccagatttggccgtgctcatcgtgaccagccacgccaggccccgacaactcaaacgcgcgcttgcagcaggtgttttaggattcttgcccaaaacatccaccgcagatgaattcgccaccgcaatccgcaccgttcacgctggacgacgctacatcgaccccgaactagccgccatgacgatcagcgccggtgaatccccattaaccaaccgtgaagaagaagtcctcgaactagcaggccaaggactaagcgccgaagaaattgcggtggcagcgcacctcgcgccgggaaccacccgcaactatttatcccaagctatgacaaaagtaggcgcgcagaatcgctttgaagcgttcacgcgcgccagggaattgggctggttgtagcttgtggcttatctcctattaaagctggagctagaaggagagaactgccagaactgtggagcctacgaaagctggtacgaaagtctcacgtgggagaccagtcatgtttacccagttgttggtgctccactcaaaccagtggttaacgatagatacgatgtccatgaaccaaacttcctttgtgtgaggtgtattcagagggccagccccaaaatacattgaccagtagtgcttcacatcacactataaaacagttagaagcacctaaacagtttttccgataactgttgtcattttgtgaccgcctggctttgtagttttccctccggtgtccaagatgaatatgacatgatgaatggcgtggtacagcctcaggaacatctcgatgcaacgttgattgctgcagacttccacggcaaccccgaaaactctggtgaccgcaaagagcgcctgaattttcaaggttggaagtatgcccttaatcgcacggtcagggatgtttttccagatggcctgctcgatttggcggccttgttgacgttcttttccattctgtcgatcgcccctgcagtgctgctgggctattcggtgatcacgatttttctggccagtgactccaccgaaatcctcaaccttgtccgcgatgaggtaaatcagtacgttccggaagatcaatcccatgttgtcaacggcgtgattgattcgatcgcaggctcggcagctgcaggtcaggtcggtgtcgcggtcggtgtgatcacggcattgtggacatcttcggcatatgtgcgcgctttttccagatgtgccaacgctgtttatggccgaagcgaaggccgcacattgatcaaacgctgggcaatgctgcttttcctcaaccttgcgttgctgcttggaatcatcatcattttggtctcctgggtgctcaacgagaccttggtgatgggaattttcgcccccatcgcggaaccacttcatctcacgaatgtgctcagcttcctcacggaccggttcatgccgatctggatctgggtgcggttcccagtgattgtgggggtgctcatcatgttcgtggccacgctgtattactgggccccgaacgcccgcccgtggaagtttcgctggctcagcctcggatcattcttggcgatcgttggcatcctgctcgcaggcgtgggcttgaatttctacttcacgctgttcgccgcttttagttcctacggcgcggtgggttcgctgctcgcggtttttattgcgctgtgggtgttcaacatttgcttaatcatcggcctgaaaatcgacgtggagatcagccgcgccaagcaactgcaggcaggaatgccggcggaggattacagtttagtgccaccacgctctatcgagaaggtggcgaaaatgaagcagcgccagcagcgcttgatggatcaggctgcggcgatccgggaggaaagcaattaaaaaattgcttatcgacgtccccctccacacacttttgcccctttaaatacttacacctttcctatagtgtgaaagctatcacagtaatagggaaggattaaccatgaagactcgtcatcgggccctctttgcgtgtatcgcggcggtttcattagtggcatctcccggtcttgcacctactgctaacgcgcaggatcgagcaccaacttcgaccgaaatcgctgtcaactccacatatggactgcttgataaccccatcacggcaccgattggattgtttattctgctgtcgtccatgacctggcacttcctcatttggtgtcccattggccagagttcaggattcattgatccgtactcaggagagtgtacgttctagcctttgttgttcttatcaaacaattgttttaagtcagtgttacctaagttaggctgttgggaattgaactgacacatagacagggttttgatgagaacaacacacaccgcttcaagcattctgcgaagaatgatcaggcggcagcggggcaaggttgcgtttggcgcattctttttggggatgtggcagctgtcggaagcattggtgccgattgcgattggtttgatcgttgatcatgcggttctcacaaaagatctccgccgattagtggtcgggcttgtcgcttttgttgtgctgtttgtggtgttgagtttttcttatcgtttcggttcgcgcgcgttgaatagggccgtgaactttgaatcccatgcgctccgcgtagaggtagccgatcatgcgttgaagaatctggatccgcgcaatttggtgcctggcgaggtgatgtcgcggtccaccgcagatgcggattcttcgacgcgtattttcgggcagatcggaaccggtgtttcggctgcgacgggatttcttggtgcagcgacctacctgttgatcagtgactggctggtcgggttgttggtgcttgtgctggtaccgatcatttcgggagtggttgcactggctagcaagggcatttctaaaaggagtgtcacccagcaggagaagttggcggagtctggtgcgcaggcaagtgacatcatgatggggctgcgcgtgatcaaggcgatcggtggcgagcgttgggccgtgaagacttttgaaaaggcgtcgcaggcatcagcgagagcggcggttgatactgcagttgcttcgggcaaagtcgctggtattggtgagttgtccattgcggtgaatttggctgcggtgttgttgcttgctggttggcgggtcaccacgggggagttggggcctggccagttgatcgcaattgtgggtgtggcggtgtatttgtcagagccgattcgcttgctgagcaactcgattaatgcctcagctattgcgcacggtgcagcggagcgggtggctaatttcttaaacctcgacgaatctcaggcacagtacgaaagcagcgaaacaatcaatgacggcgaattcctcgtcatcgtgcccccagccagcacgcttccacacggcgacaatatcttggctacacctcatgctgccgacattttcgaaggtaccttgcggtcaaatatttccatgaatcatgaggacaacgtgccaattgatccgcaggtaattcgcgcttctggtctgactgacatcattgaggtggacggacttgatgcgccggtgcgcgatacgggaagcaatttatcgggtgggcagcgtcagcgagtggctttggccagggcgttgcatgcagacgcggaagtactggtgctgatggatccaaccagcgcggtggattcagtgacggaggtgtctatcgcgcaggggattaagcagctgcgagcaggcaaaaccaccattgtggtgagttcttcgcccgcgttttacaacttggcggatcgggtgatttcacatgtctaatttgatggcatcatcgacaccgaaacaggcgttcagcgctgctttcacgcaactgaaaccgcaccggatcaagttatttggggttgttctttgtggcgtgttggtggccgtcgcggggttggtagggccctgggcggtgggtggactcgtcgataagctccttgcaaccccgagcatgcgcgacgttgtagtgttcgcgctgcttatcgtggctggcggcgttgtttcgagcctgggcacgtggtggggcagcgcgctgatggcgcgcgcgttggagccggcgatcgcggggctgcgcgaggatgtgttgcgcgcggcggtgagtttggatgcgaacacgattgaaacggcggggcgcggcgacgtgatttcgcgtatcgcggatgattcgcgggaggtgtccactgcggcgagcaccgtggtgccgctgatggtgcaggcgggctttaccgtggtgatttccgcgtttggcatggcggcggttgattggcgcctcggccttgtcggtttggtcgcgatcccgctgtattggaccacgttgcgcgtctatttaccccgctcaggtccgctttatacgcgtgagcgcgaggcctttggggtgcgcacgcagcggcttgtcggcgcagtcgaaggcgcggaaaccttgcgcgctttccgcgcagaagatacagaattaaagcgtatcgacgcagcctccggcgaagcccgcgacatttccatttctgttttcaggttcctcacatgggcattttcccgcaacaaccgcgcggaatgcatcaccctcgtgctcatcttgggcaccggcttttacctggtcaacatcgatctggtcaccgtcggcgcagtctcaaccgccgcactgatcttccaccgactcttcggtccaatcggcacgctcgtgggcatgttctccgacatccaatccgccagcgcatcgctgatccgcatggtgggcgttattaacgcggcatcgaaccaggtcagcggcacctcgccggcgtctgccagcaccgctttaacgcttttcgacgtctcccaccactatcacactgcacccgtcatcaagaatgcatccgtgcagctggaaccaggggaacacatcgccattgtgggtgcgaccggcgctggtaaaagcacgctcgccctcattgcggcaggcctgctcagcccaacttccgggcaggtggctctcggcggatcgagtttttctaacgtcgaaccggaagcattgcgccagaagatcgcgatggtcagccaagaaatccactgcttccgaggatctgttttagataatcttcgtatcgcacgccccgaagccaccgatgcggacatccacgccgttctcgccgatattggtgattcctggttggagcgcttaccgcaaggcatagacaccatcgtgggtgatggcgctttccgtttaacctctgtggaaaaccagatcatggcgcttgctcgcgtacatttggccgacctagcaatcgtcatccttgatgaagcaacggctgaatcaggctctgatcatgcaaaacagcttgaagatgcagcccttaaagtcactgaaaacagatcagccatcatcgtggctcaccgcctcaaccaagcgaaaaccgccgatcgcatcatcgtcatggactccggagaaatcatagaatctggaacccatgaagagcttcgagcgatcggcggccgatatgaacaactgtggactgcgtggtctgcgcgctaattagccacccaagaccacgccttctctacgtggatcggcgccaccgacaatggtgtcgccgtttttcaccaacgccgataggccactggattgctcgcccacattaacttcgtggcctttgctttccagttcagatacaagctctgctgaatcattggcgatcagcggatgctcgcttcccagtccagtcttaggctggttcatcgcaccaaagttgggcgcagacactgcctgctgtggatccatatcccagtcgatgatgttgaccagggttttcaccacgtactgaataatcaaggatccgccaggggagcccagcaccatattcagatccgcgatttcaccatcgccactggcgttgaacactagcattggcgacatggaagaccgtgggcgctttgctgactcgacacgattggccacgggctcgccgtcctcatcaagtggttcagcggagaaatctgtcagctgattattcaaaatgaaaccacgggtgaagtggaaggaaccgaaagcagcttccacactggtggtcaacgatgctgcgttgccataggaatcgatgatggaaatatggctggtgccactttccggcagggcagccatgactggttcctggctcagaccagcagttgcctgacccattgaatgctctggatcaataagttctgagcgttcacccgtgtagacatcgctgatcaactcttcgacaccacctgctggaacttccacgaaagcaggatcaccgatgtaagcatcgcgatcagcataagccaggcgctcagcctctgaaatcaggtgaacagcttccgcatttggcaatccgccatccaaaccaacctcagtgggtgggtattgggcgagatcaaagttgttcaagatacccagggtttccatcactgtgacgccacccgatgatgacggtggcatgccacaaacaatcttgtcgcggtagggagcacacaaagcttcacgagtttccggagtgtaggcagccaaatctgccgtgctcatcagtgatggtgtgaaaccgtcaacctcacgggtggcgcgttccacgatgtctgctgcaatctcacccgtgtagaacgcatcggggccaccttcagagatgagacgaatcgtttctgcatagtcagggttttgtaaaagtgtgccgggtgccttcgcatcaccgttttcatcaaggaaatatgcggcagcttccggatcgtgggagagatcctcagcggagttagcaattgatgctgacatgcgagggctgatggaaaaaccatcagttgcgagctgctgcggagttgtcagcacgtcctgccaggaggtctttccgaatgaatcatgcagctgtccaagggctgccacgattcctggcacaccaattgacctgccggaacgtcgggcatcaggaacaggtgccgtttgatcctctgcagaaacatgaatgagatagttttcatcagcagcaactggcgctgtttcacggccatcaatggctgtcaccgcattggcttcggcgtcgtagtacagaatgtatccgccaccaccaaggccagacgactgcggttccgtcagtcccaaaacaaactgcgcggtgacaagagcatcagctgcagtgccgccttctcttaacaccgcgcaggctgcttcagaagcgatggggtttgcagttgccaccgcataaccttgggtttgaacaggggtcatgccctcgcggtagccggtaccgatttccggggcaacagaaatatcttcacctgtgtgagtgccttctacttcctcttcagcagaagcgtcggcgggaagttcacaaggcgcaagtgggggagacgctgctgcttgggttgaggagttttcagtatccgtggagcttgcggaggtgtcttcaccgctggaacacgaagagatggtcagggttaaggctgcgacagtgaacgcagctaccgatttaaggaatgtgctttgggtcactttcatctctcgagcctatcaaggaacttttatgtggggagatattttctgaaagaaaatttaattggtagaaacccatgattgggggcttgcatttgtttcgttgttcacctaaagttaactctaggttaacaaaaagagttctcaaggtgaactcaagcgatcggtggaacatccactaacggggttaccaaaaatccttcgcggacactcccgaaggaacacttcttgcgagaaggaaaggaagaagcactgtgaagggcattcatcaggaaattagccgtatcgagcgtagccacgattatctgtggagcgtccgagaagacctgcatgcacgattcgacaaccaactgaaggcacactttgtagacagtgtcctggatagcattgcagaaggatatgaaggccgaatcaaccgattccgcaaaatcttcattgaaatgaaagcggttgaagagctgcgcaccatcgccgccacccgcccaagccacctcttggctgcataagacacttaaaagttaaataaaacaccccgctaccttattaattggtagcggggtgtttttaactattcctatttattcgcaggcaattccgtcgccatcgcgatcaagcttggaactatatccaggtgatcccgcataaaggggagctgcacccgccgcacgaactgccgcgcagttggcgtaatacgtttgagctggtgcaaccgccggtgcaggttccgggatggccgcaaactgctgtggcgtatttacctgaggctctgaatattcctccacggccgctggcttcacaatttcttgggcaagatcttccgcggaggtagtttccgtcactgtcgaggtgatcgtgctggctttagctgtggttgtcaccgtggctgttacagtttcggtaactgttggtgcaggggcttcgggttctgcagcggccgaaccgcacgcagtaataagtcccatggaaataatgagcgaggagccgataagggccattcgtttcatgcggcctgaactgcctttggtggaatgtgtaggggtggggagagtcatgatgcctcgagctggtagagaattcgatatggtcaagtatgctatcactcggttcgcgaggctgaagatttctgtgtctgtcgtctctaactacataccctaatcgggtttgtgaataacttggatcctgaagttgaagagccgaatatttctcagtgggaaagtcttgatgatgacattatccctggaaattgcactaaagtgtttctatctgaaccccagctaatgcatggtcctctccttagagcgtttggtgctgttgcaacttggggcgggagccaagaaggctccgtttttattgtgtgatcaacgctatgtgcctgtgttgtcaggccgtctcgaatacccggctaacaatcactgcatccggattcgggtgaccataggcaaacatcgtgccctgccccttccgcaatgagtgcatcgcctccatccctttcaacgtccggtaggcagacgttcggtttttgaatgcgcctttcggccccaggatccgctttaaccgaccatggtcgccttcaatgacgttgttgaggtatttcacccgacgatgctcgaccgtcgatggacagacgccttccgccttcagctcagagattgccctggcgagtgagggggccttgtcggtgctgatcacccgcggatagcctgccgatttattcgaccgcagcgtcttcgccaggaaacgcttcgccgccgcgacgtttctcttcggggagaggtagaagtccagggtctggctaccggcggtgattgcccgatagaggtagcaccactttcccccgacccggatataggtctcatccacccgccaggacctggcctgccagtcaggaacttgccgataccaccgggtcttcttatccagctcaggagcatatttctggacccagcggtagatcgtggtgtgatcgaccggcactccccgctcggtcatcatctcttcgaggtcgcgatagctcacgccgtagcggcagtaccaccgcaccgcccacaggatgatttcacgagggaactgccgaccggagaagatgcccatggacctgattattccacgccggtcttcctactgccccaactttgcaacagcaccgttttaggttatcctgcaggtgaccctgaactccaagatgatggttggtatagacaagcctttgcagatggtttcttgcatggaaaacaactgagtacattttttcccgcatgggacgagtttgcatgggacgattccgctggtggcgaaccgggggtactaatgtcaaggcaggcggcgaactatgataaaggaccagctggtggaaataaatacactgatcaggtcgttcttgaaactgaggatatgtgtggcaatgaaataatcctccgtagagggtggtacaactcggatgcctccagaaaagataagccgtgggggtacgataaaattcggcacaaacatggtgtttttagtttgtggtcagttagtatagtatttgaaaattcgtgtatcaacaggattgaaggtacacagcaggtttatgaagaagaagtttatcaagtgaaatgtgatcgactcttcttaaattgtgaacaaaccgggcagtcttttgtatatcgcggtatttatgaaagaaatatatataagcctggtgctacagagccacttggtttgaggacattttttcctgtacacaatgagggaacgcatggttcaagtgatgtaaccccaacatggtttagtacagacattccaacattggacttatggtaatgacgtacaaagcagattatgatcttgacttggaaaaagtagtttttcgtatgtcgcagctgttcgaggatcttattccgtcagaaaacgcttttgattattatgacaagtcaacgtggcctaccctgactatggctgcgacatgggttcaggatgattgtctccttattgtttttagggttgaggaaagcagaggtgagacgttcgtgggttatttttctcggatctcgcctcgatataatcccgacaacatcgaatttggtgcagtagagctaatgtatgctgactcaattgcaggtgattggtttatagagaaggtcgatctgaaagctccgcaaaagatacattggagaaatacccaccatagcctcaatactccggcggatatagaagaattattggactatgctaatgagataccaatgtggttgagtccagaccttgagaagtggatgtgatgcacaacaagaccatggtcatccagctttatctggctgagctgggtatgtaatcacttctgaacgtagtagcctccttgagattgtatttaaggaggctattgtgttttttcggtaaaggtctccgactgagctatagtcggagactatttcaatatcaccccagagggtgctgttgcaacttggctcccgccccaagttgcaacagcaccgagcgtttactgtatctctgatgcagaaaagtggaatttagagccatttgaaatagatgatcatttcaccgcagtatctggtgtcttgatcagtccacacctcgaccaaatcttgtgagtcgtcgtcattttctggtcggttaataaaaatctctgcggagaaatctccatcctccttaatatgttctggagtaaaatagaatttgctaacgatttctctattctgaaatttcgtgatgcggtttctaatatcggctgaccaaagaccatccacataggaaaccaagaagtcggggccactttccggatcgaagcccttcgaccagaccgtcacagtcgcgtcaatgccatgttcagtttctgtgaaatgttgtttatgcacgtccggttgtggaaagaggcttttcttgatcaagcgttcattccatcccagtttgatgtttttcacaaaggcatcagtatcgatatcagtgaggtcgtagaatttttcttcgtgaacagcagtgatatccttcgcgacgtctctaagctgcaaacgtgcaatcattaatggcacctctagcgtgaggttttgctcgtcgatccactcctgaatgcacacctctacagcaaggactctgtcaaacttgtcagtcatatcctattttccttaaattgcggggatagctgaggctgaagttatttcagttttgcttctctctgagaggatagtgggactaaccagccttggggaggcttggtgaatttagggtttagcggcagagcgtgaaatctctgagatcaagttacttcgggaacaaactgcgcggcagcatcgatacattgttgaagtcactcagcagatccgtgtgtgggaaattgacgctacagatcgtggacacgattttccaccaccgaaatttgaaacgttttctgaattgagtacgcgaatctacggcagcaggttaaggcagtatcaaagaaaacgaaaacccccgctcattagcactgaaagtgctggtgaacggggggttctacttgcttccccaccaggactcgaacctagaatgacggtaccaaaaaccgtagtgttgccgattacaccatggggaactgcagtaattaactgcaccgctagagtttacatcattgtcttagaaaaccaattattggggtccgcttagctgagatactctggatgacatggttcgacagcggatgaccggcaaggaacgtcgggagcaattaatctctattgggcgtgcggttttcgctgagcgcggtttcgacggcgcgagtgtggaggagattgcggcgcgtgcgaatgtgtctaagccggtggtgtatgagcatttcggtggcaaagagggcttgtatgcggtggtgattgatcgtgagatggtcaagctggaggcgatgatcacggggtcgttgcagcatggtcgttcgcgttatcgcattgagcaggcggttcttgcgttgttgacgtatgtcgaagatgagacggatggctttttgattttggtgcgcgatatgcggcccggtgagcgccggtcgtatggcactttgcttaacgacgccacgacgcaggtgtcgcacatcctcggcaatgccttcacccgatctgggctcaacgctgagtacgcgaatctttatggtcaggcgttggtgggcatggtgtcgatgacggcgcaatggtggttggatgagcgcactccgccgaaggaagaagttgccgcacatattgttaatctttgttggaatggtttgacggggatggaagccgatccgaagttaactcccatcagttctgctgagggtgcgatttttggtcaagaaaaggagagtgaagcgtgacacctatgctcgcggggctgttgaaggtcgctgcaaccgaccccaagttgaaggggttgatgtcgaatgtggggcagcagcatctgcatatcactggcattgatcaggctcgtccgtgggcgattggtgcgttggcgcatcatgctccggtgttggtggtgactgctactggccgtgaggctgaggatctcacggctgagttgaaggcgatgatgggcgataaggtggcgtggcttccgtcgtgggagactctgccacatgagcgattgagtccgggtgtggacattgtgggcaagcgtgctcaggtgctcaatcatctaggcgacctcaaagtcgtggtggctgctgcgcgtgcgttttgccagccggtactcaaagatgctgaaggtcgtgcacccctcactcttaaagaaggcgcggagtttgatttctctgccctgaccactgagctggttttccgtgcgtacaagcatgtcgatatggtggccaagcgcggtgagtttgctacccgcggtggcattttggatattttccccaccacattggattatccggtgcgtgtggagttctggggcgatgaagtctctgacattaggcagttctctgtcgccgatcagcgcaccattccagaaatcaccatcaagagcattgagattttcccggcacgggaattgctcattactgaagaagtggcatcgcgtgcggagtctcttatttctaagcacccgggcaacccgacgcttgtggagatgctgtcgaggattgcggattcccaagatgttgatggcatggaggcgttgattccggcgctgacggatacgccgatggttccgatgctggagctcatgccggaaaacacccatgtgttggtgattgctccggagaaggtgcgccgacgcattgcggatctggaagcaaccgatgctgagtttttgatggctggttgggaagcagctgcgatgggtgctgatggtccagtggctgcggaaggcctggacttggaagcttctagctatcgcagttatgaaagtttggaggtttctgcgtcgaaaagcgatgtgcgttggtggactttcgcgccgccgggcatgtttgaggcctcggaggaggcgacgctgccgcttgattttgaagccgggccggcgccgcgcggtgagctgccgaagatcgatgcgatgatggcgcagctgcttgcgcacacaaccggcggtgggcgggctgcgtttatcgcgccgacccaaggtgcgattaagcgcatggtcgatcgtttcgcggaaaagggcattcccacccatgtggcgaccccgggttgggagccaacgcctggtcaagtgactctttatcatgcgctgagccatgctggcctggtgtttccgaaggtgcgtaaacaccgcgatggcgctgcaatgccgttggtggttattacagaaaccgatctgactggtaaccgtgttggcgatattgcaggggcgaaacgtcgacctgcaaaacgccgcaacaaggtggatcctttggcgctggagccaggggatttggtggttcatgaaacccacggcattggtcgttttgtgaagatgactgaacgaaccatttctgcgggtgatgagacctcgcgccgtgaatacattgtgctggagtacgcgccatctaagcgcggacagcccggcgatcagctgtatgtgccgatggatgcgctggatatgctcagccgctacgtcggtggcgagaagccgacgctgtccaaaatgggtggttctgactggaagaacgccaagaagaaggctcgcgctgccgtgcgtgaaatcgccggtgagctggtagaactctacgctaagcgccaatccgcgccgggtcacccgtttgcgccggatacgccgtggcaaaaagagatggaagataacttcccctacgttgagaccgaagaccagatgttggcgatcgatgcggtcaaggaggacatggagaaaagtgtccccatggaccgcgtcatcatcggcgatgtgggttatggcaagacggaagtggcggtgcgcgcggcgttcaaggctgtgcaagacggcaagcaggtagccgttctggtgcccaccacgttgcttgcgcagcagcaccagtccacgtttgaagagcgtatgactggtttccctgtcaccatcaagggattgtcacgctttacttcgcctgcggaatcgcgggagattctctccggtttggctgcaggatcggtggatatcgtcatcggtactcaccgtttgctgcagactggcgtgcagtggaaaaacctagggcttgtcattgtggatgaggagcagcgtttcggcgtggaacataaggagcacatcaaggctctgcgtactcacgtggatgtgctgaccatgtccgcgaccccgattccgcgcaccctggaaatgtccatggccggtatccgtgagatgaccaccatgctcaccccgccggaagatcgccacccaattcttacctatgtgggaccgtatgaagacaagcaggtcgcggcatcaattcgccgtgagctgctgcgcgatggccaggtctttttcatccacaacaaggtggcagatattgagaagaaggcccgcgagatccgcgatctagttcccgaagcccgagtggtcgttgcccacggccagatgagtgaagagctgctggaacaaaccgttcaaggtttctgggaccgcgaatacgatgtgctggtgtgtaccaccatcgtggaaactggtctggatatttccaacgccaacacgcttatcgtggaaaatgcccaccacatgggcttgtctcagctgcaccagctgcgtggccgcgtgggtcgttcccgtgagcgcggttacgcctacttcctgtatccaaagggcgcgacactgactgaaatgtcctacgaccgcctggcaacgattgcccaaaacaatgatttgggtgccggtatggcggttgccatgaaggatttggaaatgcgtggcgccggcaacgtgctgggtgcagaacaatcaggccatatcgctggcgtgggctttgacctgtacgttcgcctcgtcggcgaagcagtggaagcctaccgcgcgctggctgatggcaaagttgttgatggcaccgtcaagggaccaaaggaaatccgcgtggaccttcccgtggatgcccacattcccgaaaagtacatcaacgccgagcgtctgcgtctggaaatctaccgcaagctcgcgcagtccgaatcggaagtggatctgcgccttgcggtggaagaaatggaagaccgctacggtcccattccagaagaagtggagcgcctgctggctgtgtccagattgcgccacctcatgcgcgaagcccacctcaccgacattgcggtgcagggcacgcgcatcaaggtccaccccgttgacctcgccgattcgcagcaagtgcgcctaaagcgcctgttcccaggcgccacctaccgcgcagccgctaaagcaatccagctgtctttcccgaagacaggcaacaaggtcacagatcctttgcttcgcgacgtcgacctcctccagtgggtagcgaacttcatttccaacatgttcaacttggaggaaatcgatgttcgcggaccacaaccaggaaagcctaagaagaaatcatcagtgatctccgtcagcctgtaattcttctttcgcgggggcgttgaattgggagttatacaactcccaatatgcgccctccagggccatcaactcacggtgattgccctgctccacgatctcgccgtctttcatcatcaaaatcaggttggcatcacgaatcgtggacaaccggtgcgcgatgacgaaggcggtgcggtcttggcgcagcttggacatggcgcgctgaatcaacaattcggtacgcgtatccaccgatgaggtggcttcatccagaatcagcagtcggggattagccaagaatgcacgcgcgatggtgatcagctggcgttcacccaccgataggttcatggcttcatcatcaagtacggtgtcgtagccttctggcagggaacggacaaaacgatccacgtaggcggccttggacgcagcaagcatttcttcctcagttgcttcaggtctaccgtaaagaatgttatccctgatggttccggcaaacagccacgtatcctgcaacaccatgccggttcgtgatcgcagatcttctctagccatggtgcggatatccacggcgtcttgtgctgtttcaccaagagtgatggaaccgctgttgatgtcgtagaaacgcatgatcaaattcaccaatgtggtcttgcccgcaccggtgggacccacgatggcaatggtgctgccggaacgaacttccagatccaagttgttgatcagtggacgatcctccgagtagccgaaggacacatctttgaattccagacggttcgcgccagcagcaacggtgttgggctgcgcaggatcactgtcctgttcgtcttcgtcgataagctcaaaaacgcgctcggcgctggccacgccggactgcagcaagttggccatggaacccaattgcgacagcggttgggtgaattggcgtgagtattggataaaggattgcacgccaccgatggatagtgatccagaggcaacctgtaagccgccaacgactgcgatggccacgtagctcaagttacccacaaacatcatggtgggcatgatgatgccagagatgaactgggcaccaaagctggccttatacacagcctgattttcttcctcgaatgcttcttgaacatccttttggtgtccgaaaaccttaaccacggcgtggccagagtaggtttcctccacgcgcgcattcaaaataccggtctgcttccactgttccgcaaagagtttctgggaacggctcgcaaccaccacagtgaccacgatggtgaccggaatggataccagcgccacgagtgcgagcagtggggagatgataaacatcatcaccaacacaccgatgacggtcagtagggaagtgatcgcctgtgacaaggtttgttgcagggattgaccgatattatccacatcgttggtcacacggctaagcagatcaccacgtttgatggaatcgaaatagctcagcggtaggcggtggattttttcctccacctccatgcgcagccggtgcatggcactttgcacgatgcggttgagcatccgcgcctggaacaacgacaacaggctaccgatgagataagcaccgatcaccagtccgaggatcatggctaatttttcaaaatcaatgcctgagcctggaacaaggttcatgtcttccatcatggaagcctgattatgtttacctgcagcctgcaactgcgcgatgatatcttcctttgacgcaccagccggcatgcgcttagataggaatccttcaaacaccacgttggtggctttacccagcaaccatgggcccaagacggtaagtccaacgctcaggacggctaggaagataacaaaaattaaggtgttacggtcatggcctagaattccgaaaagccttttggcagatggtccgaaattctgtgccttttgattcggcgcggcgtctgcctgatgggaacgcccgcgggggcctgcagtattactcatgattgcgcctgcgcagtctcttgggattcaacaatttcacggtaggtaccgcacgtgttcagcaaattcgtgtgcgttccaataccgacaacctcgccgttatcaagcaccacaatctgatcggcatctcgaatcgtgctgacacgctgggcgacaatcaacttggttgcatccggcaggttggtgctcagcgctcggcgaagagcggcgtctgtgctcacatcgagggcggagaaagaatcgtcgaaaatatagatctcaggttgcttcaacaacgccctggcaatggctagtcgctggcgctgaccaccagaaacattggttccaccctgagcaatctcagaatcaagaccctctggcatctcacgcacaaagtccgccgcctgagcaattgcaagcgcctgccacagctgcgtttccgtggcatcttcattgccataacgcaggttgctggcgatcgttccagaaaacaggaacgacttctgcggaacaagaccgatccgatcccacagcttcagcggctcaaattcacgaacatcggtgccatcgacggtaacgtcgccttcggtgacgtcgaaaagcctaggaaccagcccgatcaacgtcgtcttacccgaacccgtcgagccgatgatcgccgtcgtgctaccaggcgcaacgcggaagctcacattatttaacacggggtcatccgcgccggggtaggcaaaagtcgcgttgttgaacacgatttcgccagcgcttgtcgacggctgcgccggtgtttctggcgcctgcacagacggtgtggtttccagaacctcaccgatgcgatcagcggaaacggcagcgcgcggaaccatgacaaacatgaacgctgccatcatgacgcccatgaggatctgcatgatgtactgcaagaatgcaaagagcgtaccgatctgcgtctcgccggattccacctggaaagcaccaaaccaaatcacagcaacggcagaaaggttcatgatcagcatcacggcagggaacatcaacgccatcaggttaccggtgcgcacgccgatatcagcgacatctttactagcagtggtgaatcgttcgcgttccacatcttcacgcacgaacgcgcggatcacgcggataccggtgagctgctcgcgtataatctgattgatgcggtcaatgcgcttttgcatggtttggaacaacggaaccatgcgcacaatgatcagcgccaccacgatgatgagcaccggaatactgaccaccatcagccaagacaaaccaagatcctgacgcaccgccatgatgatgccaccaatggccagcatcggggcggaaatcatcaaagtggaggtcatctgcaccagcatctgaacctgctgcacatcgttggtgtttcgggtgatcagcgacggtgcgccaaactgacccatctcacgctcagagaagttcactaccttgccaaagatcgccgaacgcagatcgcggcccactctcatggatagtttggaaccgaaataaacaccggcgatagcgcaggcaacctggactaatgtcagggccagcatgattccaccggtgtgccaaatatagccgatatcacctgtgaccacaccattgtcaatgatgtctgcgtttagcgtggggagtaggagggaggtgattgattgcgccaattggaaaatgatgacggttaaaattaggggccatgcgggttttaaaaacctcaccaatatcgaccacagcatgaatgtattccttttggggagagtcacccggtggatgtccgggttttaagctggccacgaactgatttttcagttcatggtttctcaccaaggttacgcgtttttctagctgtggcttggggcggaagtggcggtctttttcagccaattcggcagcggaaactcgttgaggtagcaggcagcaacggcaaggccaatgcttggtaacgataattcatcgcggtaacacaagtaccaaccgtggtgttctgggtggaatttgttcttggacgcagcgagggaacggaaaccgtagaacggctccattgctcggcccaaaagctccaaaatttgtccgatggtgccgtcgtcggccacacctgggggcgtactcaaaggagcgccggacatcgacatccattccagatcgtgatcccttgcgataacgacggcctcggaaatgagaaactcgatgacagatttaaagccttgcggatcacggcgcatcacatcaagtgtgtagccgacgatgcgtcctttttcatagaccggcaaccaactggtcacaccgtgcagatgctcttcctcatcaatcgcgagaagaagataggtatctggatctgagagctcgttgacagtgccaagcgtgaagcccatctccggcagagctttatcagagacccattcttccgacagcgtgatgatcttgtgctgcatttcggcactcaaatcagcccaggttgtccagatggaacttacgccctctttggccgcgcggtttcgggcggtgcggacattttggaagtgcttacctttgaaatccgcattagctgagcttaagactgcttcctcagccacacgaagtgtgtggtggccagcgttgatgcgttcctttgagaattcttcacaaacggaataccacgcaacaatccagccttggttgctggcaaattcttcaaactgtgcggccagctctgctttagagacggatgaatccggacccagaataggctcacccaatgtaattgcgatgccccttttcacgcggtaggccacatatcctgcattttctggtgcccaccaatacgtattgccaccccaaatggtcatccaggacaagtgatcgccgctgccagagcgcaggagagtcgctgcgttttcttggtcctcgtgcgctttgttgctgggcacacccatgagcagatgataaagagttgctgctacgaccagccagaatagcgttccagtccattcaaacactgcccacccagcagggcttctggggaagagttgatggcttaacaccgtttcgatagttggtgggagatagcggaaggggagttctttgaaagccagccccaatgttggatgtgggtggaatgcgtgtggcaggaacaatgtggcaaggatccacaatgctgccgttgccaaccatgtaaccatgagagcgcctaaggatttagaaatccgggtggtatcaatcttcacctggaatgcacggcgggaaaacaccaagacggcgagcgccaccagccaaggaacgatcacgctaaaggcattgactgaccatagaagatcggtggaatcagccgatagtttggtcagctggaacatcaacactgcgatggaaatgagctgggccaaaaccgccaaaatccatgcaagtcgacgtccgcggctaagccccatcgcaaggaccacggtgaggatcagtggaatcaggttggcaacggaagggccaacaccgtgctgttggagctgatcaagcgcaccttggcatgcatcagaggtgctgtctgtgtggcagaggtgatgcatgtgttcttcagtgacaaggggctgccagatcaatttcgttgcactggaaaaagggccgtgggtgagtggattaagcgcagcaagcactggacctgctgctacggcagtgaccaaaatggccgtcataatgcgcgcttcacgcacggtgagggaaccgggaagccagcggccacctggggttttccgatgcctgttcaactcgccggcaacggtgccgatgatggtcgcggtgagcatggtgacgtcggcaagcgtgcccgtataaagcagcagcgtcaaggtgatagtaaagaggaacaatcgggtgcgccgtcgccagagcagtggcatggaggcggatgcgaaagcggcgacgccgaagacccagaaatctggggtgagcagcacatcggccaacatgttgttgccccagcggttgagatcggcttcttcgatgaggtgggcgatgccgatgcccagcggaatggaagtgatgtggataagcgctgctgtgatcgcgaatttgaggctgcccagaatccgttcagagggcaccgcaaacacgatgatccacaacgtggacatgagcgctgctgtggtggtggaagcgctaaaccctgcggtgagaaaatgcggatcattaagagaccacggcagggtgagcccaaggttgtctaccaaagagctatttgcgggatcttcggcgccaaacacttccctcaaaccccgcatgacaacgatcatgagcaggcttaacggtgcgaaacgcagggacctgcccagccatctcagaccgaataataagtaggactgtgaagcgtctttcattgttaaacctgcaatccgccgcgcttggcaacccaatcaaaagtattcgctaaagccacgcgccacacctggaaggaatgtccaccggccacggtatcaaaggtggtggacatgcccgcctgattgctcaaattatcaagatgagacagcgcgctcactgcacttttatcgttgctaccagcaataaacctgcccgaaatcccgctgtaggtatgcgctcctgagctgattgcttgattgagcagatcttccggattaacggctttgaatgcgtcttcatcgccgccgaaaagctgatcaacagtttgctggcgtgtgccaagtgttggttcttcctggcccgagaagtcaaggaaagaaccatacgcttcggggtgattggtcatgatctgcaaagcacaggtgccgccgtaacttaaaccaccaattgtccaggtgcgctgatcctgattgactcggaatttctgtttgatcaacatggggacatcgtgggatagatatgtcatcacgctttgggcatcagaatccacgcaagcagggtttccgctgaatgatcctgtgccatccacgctgatgacaatggggctgatgccatcgtgggttgcttggaaattatctgctgtttgatcggcatttccactgctaaaccactgatctggctggccggggtttccgggcatgagaaccaaaactggcagttgtagggaaggattatcccaatacgcaggcggaatataggcgtaggcatcgcgcgcatcaaagccggaggtggaatcatctgttgttccagctagcggcacctgcacaagggcaccgacttcacggtcatccatcgtcggggcagtggtctgagattcaaaatctgcatacgacatggacacagccgttggcacgggattgaaagaacccaacgtcgggtatggctggtagatgacattgatgactgcggccgtattaaccagtgcaatcacggtgagtgtagccatcagtattcttgtacgaccagtgcggaacaagatgctcaacagaggaaaaaccgccaaaccagcggaaagatagatggtccacggattggggtcggggaaaggcttccacagcttttcaataaccacccatgcgccactggtgagaactgctgaggagatgagagctccgagaacccgccaccgagagcgctttttcacaactccgagcagagccacagcagaagtaaacacggccacactgatgatcacggtcagcgccgtggaatctacaagcgagactgttcgccattcattcacaccgccattatcctcccaaagctctcaagaaattgcggtaaaacttaaaaatcttggtgaactagcaggaaggtttcggtgtttaaagcgatagtgatccgttgaccaaaccaataacgcccgcgctggcagcaacgaccaggacaacaaccacgccgatttcaaagcggttaaacacctgttcgccacgataaatccttgtccacacataggggattaagccgggaagcatcgccatggctccgaagaggacaaactgcggttctgcagcgtaaaacagccacactgaatacaccgttgctactaaaccgacgatgaggtgtttgcggttttctcggcgggatatctctggaccggaatcatcaaaacgtgtgccggcatgtgggtgggtgattccttttccacgtgttgccagcatgaccagataaaaggcagagaacaggtaaggcaccaagtataggttggtagccaattgcaccatggagacgtaggtggtctcgttgaggaagaaaatgatgatgaaaatctgaatcacgatggtggagatcagctgagccatccaggcagcaccgcggctgttgatggccccgattttgcttggaatgaggccatccattgccatcaacgccagtggttctgcgcagagcatctgccaggacacataggccccaagaaccgaaagacacagacccaacgaaatcaatgcggcaccccatggaccaacaacagcttcgagcaccgacgccatggaattatctggtaacgcagcgagctcttgttgggtcagtacaccgaagctcagcgaagaaatcgacaccagcaaaaggagaacagccacaaaaccaatcacggtagctcggctgacatcactgcgtgagcgtgcctggcgggaatataccgatgcaccttcgataccgatgaacacccacacggtgtacaccatgatgccgcgcacctgatcaaaaatgctgcccacgccaccatcacgcgcccataaatcaacagtgaacttctcccagctaaagcccaagaatgcaacaaggatgatgaagcacaacagaggcagaattttggccacggtggtgaccgttgtcaagaaagcagcttggctaattcctcgggaaacaactccaaacaccagccaggtcaaagcgctaactgccaacgctgacacaaatggatgatcttgggaaaacagcggtacgtagtggcccaacgtggagaaaaataacgttgcgtagccaacttgggcgatgactgaacccagccaataaccccaagcggaggagaaacctacataatcgcccaatccaacacgcgcatatgcgtagacgccagaatcgaggtgaggtttacggcgggcaagaacatggaacacgaacgctacggacaacatgcccacaccggcgatcagccagccgatgagcatcgcgccgggacctgcgactgagccgatgttttgagggatggagaaaattcccgcgccgacggtcgatccgatgatcagcgcgatgagggttctaatagatacagtacgacttgtggccgctgcaccttgagaccccgcagaatctgattgagtattcactcatttaacgtagttgacgtacggcgaagtcgctaaacttcgcgtaatcttggggccaattaatcaagtgcagatgaattgtttagaaaggctggagaccatgggtatttttgacgaagctaagaagaaggcaaccgaattcctcgactctgattcaggcgagcagaagtccgatggactgctggataaggccgcagacaaagctaagggtctcctcggtgaagacaaagcggatcagattaacaaggtccgtgacgctgtcgatgagcgcattggcaaaaacaacggcggcgaagagaatccagccaactagtattaggcgtcatgcgcgtcgtagttgttgatcctaaacaccccgtccttccagtctctttcctcgaggctgttcttgggcggggtgaacctgtttctatcgatcccgattttccatttgatattgaaaaatgggggatcaagacgtcgacaagcgcctcctggtttatcatcgcaaaaccgcaaagcacgctgcttatcgacgcgcccctcaaccctttgcatgaggccgtcggcgtcatgcgggcggccgtgggccgcggcgagtgggaacgcacgcaaacccatgagagtttgattccgtatctggaagaagaatcgcaggagtttattgaagcgattcatggtggcgatgatgagcacatgaaaagcgaactgggggatgttttgctgcaggtgctttttcatgcagaaatcgccgcccgtcagggtcgattcgacatttttgacgtggcggcgagtttcgtagccaagatgcaatctcgttcgccgtacctgttcgacggctctaccggaattgtggacaccgacgagcagcagcggctgtgggctcaaggaaaagcccaagagaaactaagcagtgaagaaggaagaagataggttagaggacagaagctgcagctgggagaggaagtcctgtggatcttccttcacgattccgcaggtcagtgcgcggttagcgatgcgctcggagtagccggtagccgcgatattcaatgggaagtctagttggccgacagctgcggagttgcgcagattagcggcgagctctgagcgagtggagttctcgtgagccaggccggtggtgtagatagcggtctgaaggatgccgcaatcaaagttgtcgatgatttggttgaaatcctgtgcggaagctgagggggtaaggctcgcagtcagggcaacggtagcggcagcgatggtggcgaaacgtagtttcttcatgggtttccttaagagatcactgagatggaaatgaaataaatatggcaaaagccacaacagtccaaaatcatacgttactgaagtgatttatgtgactgttgtgacttaagtgatttttggggttacccccgaaccttttaggaagagaagttggaggacagctcagaaaggtaggtgtcagccttaactaggccacaggtttgtgcgcggtcggcaagtgctgctgcctgatcttcgttccaatcaccgatttgtgggaactgagtggtccagaagccttcaccctttgcggcgattgcttctgcgagctcgcggttgtactggccttcttcaaggacgccagctgctttgaggccaccctcaaggatgccgcaagcaacccagttgtactgaggggacagttctttgttggtggaggataggtttgcgaagtcggatgcggaagcaggtgctgcgaatgctgccactgtgatgcctgcggttgctgccattgctgcgatgcggtgtgaaagcttcatgatttttagggctccttttaaggtttaagtccttgggtaatatgaataactcaccacacattgtaaatttgtgatgtagatcatcaaagcttctaccagtggatttaatgaagtttcagtcgtggaaatcaggtcttggcacggtgtatgtgaatgctctactaattgcataggaggctgatttagcgtgtctttttgggtcttttggttagaaagacacaggattttttacttaaagaggcgtgaagtaatcaggtttttctagccaatgcgagagttctaaaacgagccggtaacatcgacccccatgagttcaggggttagaaaagcaatgggatttggatgcggttcggttttggccgtcatcatggtgatctcatttgttggatgggcgctcagcttcatggatggaacggcacctattcgccaactccagcaaatccctgaagatgttccgccggcgcgtggtgtagaagttccgcaaattgatacagaggcagatggacgcacatccaaccatttgcgtttttgggcggaaccaattgctcaagatactggtgtgtccgctcaagcgattgcggcttatggaaacgcagagctcatcgcgagtactgcgtggcctggctgcaatctggggtggaataccttggcaggtatcggccaggtggaaacccgtcacggtacctacaacggcaaaatgttcgggggcagttccctggatgaaaatggagttgcaacccctccaatcatcggcgttccacttgatggttcaccggggtttgcggaaattcccgacactgatggtggggaattagatggcgatactgaatatgatcgcgcggtaggtcccatgcagttcattccggaaacgtggcgacttatgggattggatgcaaacggtgatggggtagcggaccccaaccaaattgatgacgcagcattgagtgccgcaaacctgttgtgttccaacgatcgtgacttgtccactcctgaaggatggaccgcagctgttcattcttacaacatgtctaatcagtatttgatggacgttcgagatgctgccgcgtcctacgctttacgacagccggcgatctaaaacttaacaagcgcaacccccgaaaatgtgagattatgtctgatcggacacgtgcgggctggggatatgggtagttttcgccactaatttcaactgattgcctcatcgaaacaagattcgtgcaacaattgggtgtagacgtgattgaagacatttgatcacgtgaataattctagttagctcccaagttggcataggaggccacagtggctgaaatcatgcacgtattcgctcgcgaaattctcgactcccgcggtaacccaaccgtcgaggcagaggttttcctggatgacggttcccacggtgtcgcaggtgttccatccggcgcatccaccggcgtccacgaggctcatgagctgcgtgacggtggcgatcgctacctgggcaagggcgttttgaaggcagttgaaaacgtcaacgaagaaatcggcgacgagctcgctggcctagaggctgacgatcagcgcctcatcgacgaagcaatgatcaagcttgatggcaccgccaacaagtcccgcctgggtgcaaacgcaatccttggtgtttccatggctgttgcaaaggctgctgctgattccgcaggcctcccactgttccgctacatcggtggaccaaacgcacacgttcttccagttccaatgatgaacatcatcaacggtggcgctcacgctgactccggtgttgacgttcaggaattcatgatcgctccaatcggtgcagagaccttctctgaggctctccgcaacggcgcggaggtctaccacgcactgaagtccgtcatcaaggaaaagggcctgtccaccggacttggcgatgagggcggcttcgctccttccgtcggctccacccgtgaggctcttgaccttatcgttgaggcaatcgagaaggctggcttcaccccaggcaaggacatcgctcttgctctggacgttgcttcctctgagttcttcaaggacggcacctaccacttcgaaggtggccagcactccgcagctgagatggcaaacgtttacgctgagctcgttgacgcgtacccaatcgtctccatcgaggacccactgcaggaagatgactgggagggttacaccaacctcaccgcaaccatcggcgacaaggttcagatcgttggcgacgacttcttcgtcaccaaccctgagcgcctgaaggagggcatcgctaagaaggctgccaactccatcctggttaaggtgaaccagatcggtaccctcaccgagaccttcgacgctgtcgacatggctcaccgcgcaggctacacctccatgatgtcccaccgttccggtgagaccgaggacaccaccattgctgacctcgcagttgcactcaactgtggccagatcaagactggtgctccagcacgttccgaccgtgtcgcaaagtacaaccagcttctccgcatcgagcagctgcttggcgacgccggcgtctacgcaggtcgcagcgcattcccacgctttcagggctaaataaaagcgcttttcgacgcccggtaacctcaaggttgccgggcgtcgttgccttactactgttactggtgtgactatgatcgaggattatggcaaagcagaagaaaactcataaaggccttgttcctgtctcaagcagggaacgtgcttcagagtcagtttctgctacccgcgccccatttagattgggtgccgtcggcatcggtgcaatcgcactcgtagttcttctcatcctgtttgtcatcgcgattcctgtgcgtaactattttcagctgcgctccgacatcgcccaaacagaggcttccattgaagccaaagaacaacagatcaaacaactggaatctgacctcaacaggtaccaatcagaggcgtacatccgcgaacaagcacgcctgcgcctaggcgtcattgaacctggagaaaccgcgttcagaatcgtggacccagcactagataccgacacctcagtcacctctgacggcaacgaagagaaaccactgggagcttggtatgaaaacctctgggactcagtcaccaagccagaagcactcggcgaagaggaaattgcgcctccagcagttgagggagaagttccaacacttgcaccaactgaggaagcaactgtgcaatagcgctttagacacagactcatgacagaatagaagacatgagtgtgaatgaagcagatctgaacgctgtcgaagagcaattgggaagggccccacgaggtgtcctcgatatttcttaccgcagccctgatggagtacccggtgtggtgatgaccgcaccaaaactggatgacggaaccccattcccaaccctgtactacttgacagatccacgcctgaccaccgaggcatcccgcctcgaggtcgcattggtaatgaagtggatgactgatcgcctttccaccgacgaagagcttcgtgccgactaccagcgcgcccacgagcacttcctggcaaagcgcaacgcaattgaagatctcggcacggatttctccggcggtggcatgcctgaccgagtgaagtgcctccacgtcctcatcgcctatgcactggcagaaggcccagaccatttccgtctcggcaccgaagcagtagcaatggctgccgaacacggcgacctccgcggtaccgccatcccagaggactggccaacagtacaagacctgggcatcaacatggaggactttgatttctcccgagcaggtggggcttaatgacccgttacgcggccatcgattgcggaacaaactccatccgcctcctgatcactgaagtcactcctgagggattcaaagagatcacccgtgaaaacaccatcgttcgcctgggcaaaggcgtcgacgccaccggtcagctagaccccgaggcaatcgagcgcactcgtgtcgctttggaaaactacgttgaactcatggaaacccatggggtagaggccgtacgaatggttgccacctccgcaacccgcgatgcgtccaaccgcgatgaattcttttcgatgacccgccagcttctgtccaagatccgtcctggataccaagctgaagtaatttccggcgaagaggaagctctgctgtccttccgaggtgcaatcgttgacctgcctgaagaccaaggtcctttctgtgttatcgaccttggcggtggatccactgagttcatcgttggcacctacgacggtgaaatcctaggctcccactcaacccaaatgggatgcgtgcgcctgaccgaacgaatcatgcgcagcgacccaccgactgaaaccgaagtggaaatcgcccgcgactacgttgcagaacgcatccaggaagtaaaagccatcgtcccaatttcaaaggcaaaaacctttgtgggatgcgcaggcaccttcaccacaatctccgcctgggtgcaaggcctagaaagctacgaccgcgacgcgatccacctctctgcactcaacttcgatgcactgcgagttgtcaccgatgagatcatttcagaatcatcatcacagcgcgccagcaacccagttgttgatccaggtcgcgccgacgtcatcggtggcggatccgttgttgtccaagcagcgatcgacttagcctccaaagaagccggtgtagactacatcattatttccgaaaaagacatcctcgacggcctcatccttggcctggtagaagccgactctttgaagaaataggaccctagttttaaaccactgggtcatcatgttctatgatgtgtaagcaccaagtaaatggcattggaagcatacatatgtatcctgacaatgctgcttgcccccatagcccaatcggcagaggcggttgacttaaaatcaatacagtgtgggttcgagtcccactgggggcaccataaccagcggaaacgctaaaaatatggagctgtcttagacttaagtgtctagagagtgtccaaaaaagaaatctccacggcgaagatagctgtggagattcttcgtcgtgtgatcgtttgaaatcacatcacagtgttgtgaggtcagtgttcgctccgcacacaatgactgccactttttcatctgctgcaggtttgtatgctccactggtaagagaggcgagtgctgcggcagcgccatgctcggcagggatgcggtagttgtcccagaggtggcgtcgagctgcgatgattgcttcatcgtccactaggacgcctattgggggatgggcagttgcgatgtcaaaggcttctcgtccaatttggcgagcccccaaagaatctgccgcgataccagaaacgttcacatcgactggttggccggcaatgagtgagttgtgcagggttggaattttggagggttcaacggccaccactttgatgtcgtgggctgctacgacggctgcgattcctgcatagagtccaccgccaccgacagcaaccacgatggtgtcaacgtcgggaagatcttcgacaatttctagcccaatgacgcctgctccagctgcgatgtcgggctggtcgtaggcgtggcaaaacagagcaccagtttccgactcaaaggtttgagctgcctcaaatgcttccgcatattcagatccgatttgttgcacggttgcaccgtattgcttgaggcgatcaacttttacttgtggggcagtttcgggcaccaataccgtggcgggaacgcttaaggatgctgcggcaaaagcatttgcgagtcctgcgtttccgcctgatgccgcgacgatgccaaccgttgggtcgagtagtccgttttccgaagctgcgagctggcggttgaatgctccacgcgttttgaacacgccgcacttttggaggaactctgctttgatccagatttgtgtgccgtcgatggggtctgcttcgaaaagtggcgttcgtcgaacatgaggggcggttcgttgttgggcggtgatgacatcgttgagggtgagcatgcctgtgttttctagaactcgatgaaaatgaacattattatgaacgtgaggttcaatttgctaaacggcttgggtgagtgcaagcagaatttctgggcacagatgaattggcggaaaggaacgtagactgtcatgcctgcaattgaacttccagaacctaacgaaccggttccagctggtgatttcattgccgatccagatgccacaatgcattactttgcagtggaccgttccggatcccttcaatgggagcaaggctcatttagctacttcgacgtggaagcgcacatcgttgagttgattcctgcatcagtaagcgatgcgttttaggcacatctgcgatccgtgggcgtgtcctacatcatcgccggcgatgagcagctggatatggcagaagccgttcgcaaaattggggagacctttaaaactgaggaaattatccttggtggcggaggaaccctgaactggtccatgctccgcgacggtttgtgcgacgaggttagcatcgtgatgatgccaatcgccgatggtgaaaagcacacccactctttgttcgaagccgatgaaaaatactcagcaccgttgccgatcggtttttcactcgccagcgttgaaccactagaagatggaagcgtttggatgcgttacggggtcaatggcccagtggacgcgaactaggtagcaaatactcgctctttaggtgagagagctaggcgagttaaggcccgacccctattttccagggatcgggccttttctaagtttgagtagcctgggggtattttcggtagcgtataagtcccacgacatatttaaatacggagtctttaggagattaagaagatggataaggtcaaattctttcgctcccgggacaacaaaaatattgcgggcgtgtgcgcgggagtcgcgaagtattacgacctcgacgcggatacagtgcgctactggtacgtttttgctcatttctttggtgttccgatgttctcggtttatctaattcaatggctaatttatccccaggaggagagttagcgcagcgacctgctcgcaaagttgctgaaccgatgggggagatcccagaggcatagaagggtttaggcgcgccgacgcgctgaggtccggaggtgggcgtcgaaaagcaaaatgctttcaaaaggcctatggctgaattagtctcttgcaatacttcgcatctggaatgtaacatcatttcgaagatatgaggttagcgtaacctacattgtgaaatttgcttgtagtgaggatgagatatgagttctgccagcttgttgtggtgccattccggtgtgtcaacagttcgttttggcgagagaattttcactctcgtcgcaggcgacctgctgttcgcgcctgaggaagcccaggttgccgatgattctcaaggacttgttctcaacatccgctttgagaccctcaacatcatgggacctgcgcgtcgcatccacctgggtcacgtgtggaatgatcgcctgacctttgaatacagtcgctcgctgttcggtaaagagaccctgtcgccagacatcgcgcgcctgttcaccgaccgcgttcccacccctccgctgccagctccgcgtaaagcgcgcgcagtggcgcaggtgctggtgtccaaccctgcggatcagaccagtttggaagaatttgcggagatccaaggcgtttcggcgcgtactttgcagcgccagttcctcaaatccacgggctattcattcagcgaatggcgtgctgcgcagcgcgtctgcgtcgccgcgagcctgctggcccacgacttcagcatttcagtggttgcgaacctcgtcgggttcgccgcgaccagcagcttgaccagagcttttcgacgccacaccggtgcaactccgtccacctttactactggacagatcggcatgggctccgcaggtcacccaccacgcatcccagcaaccaccacgtttgccgaagcgcatcaggaccagcagctgtggatttacagcggaaccgcaaccgtcaccacccccggctactgccgattcatgggacaaggtgacatggtgaccatccctgccggcacccaaacccgcattgacgtggcagccggatccatcgcattcccagtcccagttggactcgacgaatggggaatggacctaacccgcgtcgtggctgttaataaccagcagccaaagccactgaccattttggaacagtctgaatggtccaagctcagcgaagaacttctgaacactcctgtacctgtacaaatgtgaaggtagtaaaggtgtgaaaatagttcctcacgtggggaactatactgatccttgatgcgttaacttgattgacgacgaaaaatcaattgaaaggatcggggactccgtgcgaagcagcaatcccgtttttagttcccttaaggaaactcaacgtccacaaggccagaacccatacggtggttacgacaacttcggtggtgtctaccagcaaaacgtagctccacagaaggcggagcgcccaatgactgtggatgatgtgatcaccaagactggtatcactctcgcggttattatcgtttttgcattggtcacctttggcgtgtggttggttagccccggcctcggaatgatcttgacccttgttggtgccatcggtggtttcatcaccgttctggtcagcaccttcggcaagaagtacggatctgcggcagtcactttgatttacgcagtattcgaaggcctcttcgtcggcggaatttcccttctgctgtccggcttcacagttggtaacgccaacgcaggtggcctcattggccaggcagtccttggcaccatcggtgtattcattggcatgctgtttgtatacaagactggcgctatcaaggtcactcctaagttcaaccgcatcctcaccggcatgatggttggcgtcctggttcttgtcctgggcaacgttgtatgggcactgttcactggtggcgcaagcccactgcgtgacggtggaatcatcgcgattatcttctccctcttctgcatcggcctggcagcattcagcttcctctccgacttcgatgcagctgaccgcctcgtccgcgaaggtgcaccttccaagatggcatggggcgttgcgcttggtcttgcagtgaccttggtctggctctacaccgaaatcctacgtctgcttagctacttccaaaaccgctagtttacgcagcacaagaccccttcatcctgttcttcttgggcagggaaggggtcttttggcttctgatgggggctctgtgagcatggggcggggtgagttcttgggcacctgtcatatccaaaccaaagacgtgcgttgtggagggctctttggtctcaaacgcacacttcaacgcgcgataaatgtgcgtttgagaccaaagcgagctcgatttttgaggctccttggttcgaatatgcagttcggcggtgggacccaataaaaactgccacggcgcccaaagaaaatggcttctcagaatcgcctgtggccgtctcaaactgtcattgccatacgcgaactcatggacacaatttaaacttcttaaatagcctccaggagaagacaacaaaaggcccctatttcctaaaacaggaagtaggggccttacgctctctaattatggaggattagaggaagagaacctgtccatcgacggtgacctgagtgaacactaggccttgggaagactcggtggggaaggaaagcttcacctcaatatcttcggtttcggtctcttgaccatttgcagcggttacgatgcgggtaccggttccagttgcggaatcagtatcccattcgctccaagaaatatccgtgagccgatcaatatccattgcacagtttagtgagatttcagcaggttgctgagttggtgcggctacgcaatcaatgtagccaggcgcatcctcatctgtagtagcagttgaggtcgcggaaacgttcttcgaaggtaaagaaacgccagttgccgttggcaccttcagttcagaatcaatctcattaggggaacacgcaaccagtgcgactgccgccagggctgtggtagcagaaacgaagaacttacgtgaaagagttgtcattttgaagacttttaaatccttggttagtttttgccgcggagtgtcgcggcttttgctgagttgtatggttctgcagaaacaacagttacggagataacggaaccatttggagcggtgtactgacgggtgtcgccttcctgagctccgagaattgcagcgccgagtggggactgctcagagtaggtctcaagatctgggttctcggaagcgccagcacgggtaccgatgaggaaggtttccttgtcgttctcgtcgccgtcgtagtagacgtgaacaacggagccaacgtttgcgacaccttcgatgatgccttcgcgctcagtggtggagttggccagcagctcagagatctgcttgatgcgggcctcttcctggtcctgcatttcacgagcggcgtcatagccagcgttttccttgaggtcgccttcttcacggcgctcattgatttccgcagcaactgcagggcggtgtgcgatgagggcgttgagctcttcctccagcttggccttggtttctggggtgatgtattgcttatctacacttgccataattacttaccctcctggggaacagtagaggtggatcatcggctaactagcgacttgagccataagattggccccggttttccggggccaagatgtatgagcttttgcgttaactattaaccgacaatgtcaacgtacgtttctgctgcagattttagcacagcaaaattttctagttttacaggttcatatgtgatgggatcacggttgaacaaccgtaaacaccaccggaaactgctggttcgcgggtggggatcagcgtggagatacgcaccgttgagtggtcgctgggctccacaagcacttctcgacgcccgacttctgcgtgcgagtagtcctttgcggtcacgatgcagtaggcgacttggcttgggtcatcgcgggtgacgtcaacttcaaagcggaaggtgtcgtcgtcgatgcgttcaaatgaacccatttggccggacactgtttgtgcatcgcggtttttgaggaagtttgcgccaacaatcacaatggcgatcaccagcagcacgccaatgactgcgatgatttttccgctgatgttcctgcctgcagcagcttccgggcgaggcgaattgtatcggctagccggacgttgggtgtttggaatgttcgaagcgcctgatgcgttggatggagagttggaatttgtactcatgatggaagtctgtctgcatcctcttcaaagccgaatcgagttggtcacctatacatcttagtcacctcaggaaaaactgttaaccgaggtcatccaaggggtaaataggtatgacggcggaaacgactatcatgaatgcaatacacatcaactaaaccctgcggaagcatataaagcttcaaggaaaggatgaaacacgtgagtggtctacgcctaatggcgatccacgcccaccctgacgacgagtcaagcaagggcgcagcaaccatggcgcgctatgcagctgagggcaatcaagtaatggttgttacctgcactggtggtgagcgtggagacattctcaaccctgctatggataagccaggaatcctggacaatatttttgctgtgcgtcaggaagagatggcgaaggccatggaaattcttggcactgagcacagatggctaggttatgaggactctgggctgccccaaggtgatcctttgcctcctctgcctgagggctgttttgctttagaagactcggataaagtcacccaagatttagtgaagattctgcgcgagttccgcccacacgtcatcattacctatgatgagaacggcggttacccacacccggatcacctcaaggttcatgaggtgtcgatgcttgcatgggagaagtccggcgatgcagcgtatgcacctgagttgggcgcaccgtgggagccactgaagctttattacacccacggctttatccgtcagcgcatggaaatgttccatgatctgctcattgaacagggcaagcccagcccatacaccccgatgcttgagcgttggaaggcaaatgaggctgatgtgatggctcgagttaccactcaggttccttgtgagcgcttctttgatcagcgtgatgacgccctgcgtgcgcacgcaactcagattgatcctgcgggtgctttctttggaactcccgttgaggtgcagcgtcgcctgtggccgactgaagagttcgaattagctaaaactcgtgtgaagacgtcgatcccagaagatgacctgtttgccggaatcacacccgatgcagaataatgcagttagaccacatcctttaggaaggaccttttcggcgtgattgacctcagccctgtattcaatacagctgccggcgtatacaacgacaccaacgcaatcatcttggctcagcagcagcaaggtggaccacttggacctgagtttggaaaggcctcgccggttggtttgctactgatcgtcgcgatgctcgttgccattcttgttctcggctgggcgttccaccgacgctggtcacggatgaatcgtcgtcgtattttcgcagagcgcaacggccttgatcccttcgatattgagggtgttcgcaaggcaatggctgaggccggcttgaatgaaaagtccaaaaagggcttcctttaaaaagaaagtgtgttaaggttccaaactatgttcgcagcacgattttattttatgtccggctccggggcctccccgcgtcagctggccattagttgtgccacctaaaacgcgaacagaaccggagtcgagcagcacctccccgcaagggtagaggggctgcttttttgtttcctaaattcaccccatcccatgcatagccctgaaaggcaagaaaaaatgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaagtaattaagggcgctagactgttaaatgtgttaaacctgcccagactgctgtacccggtgtatgagcgccgtcttttaagagaactagacggcgccaaacagcccggtcacgttgccatcatgtgtgatggcaaccgacgctgggcccgggaagcgggcttcactgatgtcagccatgggcaccgagtgggtgccaaaaagatcggcgagatggtccgctggtgtgatgatgtagacgtcaatctcgtgaccgtttatttgctgtctatggaaaaccttgggcgatcctccgaagagctgcaattgctgttcgatatcatcgccgatgtcgctgatgaactcgcgcgtcctgaaaccaactgtcgagtccgcctcgttggtcatttagatctgctcccagacccagttgcttgtcgtttacgcaaagctgaagaagctaccgttaacaacacaggcatcgcagtcaacatggctgtcggttatggcggacgccaggaaatcgttgatgccgtgcaaaaacttctgaccatcggcaaggacgagggcctaagcgttgatgaactgatcgaatccgtcaaggtagatgcgatctccactcacctgtacacctctggccaaccagacccagacctggtgatccgcacctctggtgagcagcgactttccggattcatgctgtggcaatctgcctactccgaaatctggttcacagacacctactggccagccttccgacgcatcgacttcctccgcgccattcgcgactactcgcagcgcagcagaagattcggtaaataacttattctccaaggagagacatgtctgactacatcgtcgcatttgaatccgcatacggctctaccaagcagtacgcagaatctctggcgcaacgcctcggcgtagatgccttaaattttgaacaagcgtgtgcggaactcgcggcgaacccgaccgcagcaatcgtggttttgagctttgttcacggcccatcccatccaggtgcgaaattcattaccgataccgatctctccggccaccgcgtcgcactgtgcaccgtcggcatgacgcttgatgatgtcgtgcaaaagaaggacggcgcagctcgatcactgggaaacaaggcagacgatgtcacccgtttctaccttccgggacgccttaattactcagagctctcgaccgcgcaccgcaccaccatgtggacgatcgtcaacatgctgaaagcgaagccgttgaagaatgacaacgacaaaatgatgatcaacacttttgataccgatgttgaccgcgtcgatgagtcccgcctggacgcagtggaggagtgggcgaggggcctctagagtgggcgttgcaaaaactcactgtgaggcgttttgagcagtcggaattttcgaaggtgtgtgcgtctggatatgctgacgccaagcctttagaagcgaatttagacctatgtatttttgggcacatctgcgctggatacagtgggttttgagctcgactgcattttgaggccaaaagccacagtgcggctcaaccccttggtttaacatgacacttaatcgtcgggataagtgcagatttaggccaaaggagccctcaatcagcgcggctttggtctcaatttcaacttggcgcggacgaacagggtcaaacacggccgaaccgtagaaatctgccacttagcaagggattccctactcaaaaccagcaagaacccctagatcttgcgcatcctcacccgttccaccaagtgatcgctaccttttttcagtaccaacgacgcgcgaactcgggtgggaagaatattctccaccaagttgggcaggttgatcgattgccacagttctcgagcgacggcgatggactctggatcagccatgtcggcgtaatgggagaagtgggcaccggggcgacggaatgcagtgtcgcggagtttgaggaagcggtcgatgtaccatttttcgatatcttcggtgcgggcatctacgtagacgctgaagtcgaaaaggtcactgaccatcaatgttgggccagtttggaggacgtttaagccttcgacgatcaaaatgtcgggttggcggactgtggtgaattcgcctggaactcggtcgtacgcggtgtgggagtagacaggtgcgttgacttcgagttttccggattttacgtcggtgacaaagcggaggagtgcacgttggtcgtagctttcggggaatccttttcgggacattaatccgcggcggattagttccgcgccgggatagaggaatccgtcggtggtgacgaggtccacgcgggggtgggaattccagcgctgaagcagaacttggaggagtcgggcggtggttgatttaccgacggcgacggatcccgcgacaccaatgacaaacggcacagagatagagggggaagttccgaggaaggtttcggtggctgcagtaagttgctgtcgggccgctacctggaggtgaatcagacgggacagcggaaggtagacttctgccacttcagcgaggtcaatgttttctccgatgcctcgaagttcaatgacttctttttgggtcagcacctgaggcattgagtttctcagctcgcgccattgtgcgcggtcgaaatcaaggtaggggctgaaatctggtgtgcgtggggaaggtttcacaccagttgtgcttgcagcgttttgctctgccatgaatccattgtgcaccttagctactccactagtgtgatcggggttattttttcacttcaatgggtggctaaaagacgtgggcacgtgagtaaactcatgcgcgcgaaacgatgggagtgaacccatacttttatatatgggtatcggcggtctatgcttgtgggcgtacctgtcccgcgagtgaggtcttacgcgcgggattcgtcttgtgaaaggttagctgacctgatgaccgatgcccaccaagcggacgatgtccgttaccagccactgaacgagcttgatcctgaggtggctgctgccatcgctggggaacttgcccgtcaacgcgatacattagagatgatcgcgtctgagaacttcgttccccgttctgttttgcaggcgcagggttctgttcttaccaataagtatgccgagggttaccctggccgccgttactacggtggttgcgaacaagttgacatcattgaggatcttgcacgtgatcgtgcgaaggctctcttcggtgcagagttcgccaatgttcagcctcactctggcgcacaggctaatgctgctgtgctgatgactttggctgagccaggcgacaagatcatgggtctgtctttggctcatggtggtcacttgacccacggaatgaagttgaacttctccggaaagctgtacgaggttgttgcgtacggtgttgatcctgagaccatgcgtgttgatatggatcaggttcgtgagattgctctgaaggagcagccaaaggtaattatcgctggctggtctgcataccctcgccaccttgatttcgaggctttccagtctattgctgcggaagttggcgcgaagctgtgggtcgatatggctcacttcgctggtcttgttgctgctggtttgcacccaagcccagttccttactctgatgttgtttcttccactgtccacaagactttgggtggacctcgttccggcatcattctggctaagcaggagtacgcgaagaagctgaactcttccgtattcccaggtcagcagggtggtcctttgatgcacgcagttgctgcgaaggctacttctttgaagattgctggcactgagcagttccgtgaccgtcaggctcgcacgttggagggtgctcgcattcttgctgagcgtctgactgcttctgatgcgaaggccgctggcgtggatgtcttgaccggtggcactgatgtgcacttggttttggctgatctgcgtaactcccagatggatggccagcaggcggaagatctgctgcacgaggttggtatcactgtgaaccgtaacgcggttcctttcgatcctcgtccaccaatggttacttctggtctgcgtattggtactcctgcgctggctacccgtggtttcgatattcctgcattcactgaggttgcagacatcattggtactgctttggctaatggtaagtccgcagacattgagtctctgcgtggccgtgtagcaaagcttgctgcagattacccactgtatgagggcttggaagactggaccatcgtctaagtttttctttgagttttcatatgtagaaggcatcgtcggcttcggcctggcggtgcttttctcgttgttttgtggttttgtcagaggatgtcatgcgcgttttaattattgataattatgattctttcacgtttaatctcgccacctatgtggaagaggttacgggtcaggcacctgtggtggtgcctaatgatcaagaaatagatgagatgcttttcgacgccgtcatcctctcacctggcccgggccacgccggcgttgcggctgattttggtatctgtgcaggcgtcattgagcgtgcacgcgttccgattttgggtgtgtgtttaggccaccagggcattgcgttggcctatggcggtgatgttgatttggcgcccaggccggtccacggtgaggtttcgcagatcacccatgatggttcaggtttatttgcaggcatccctgaaacgtttgaggcggtgcgttatcactcgatggtggcaacccgcttgccggagtcattgaaagctacagctaccagcgatgatggtttgatcatggcattggcacatgaagtgcttccgcagtggggtgtgcaatttcatccggaatctattggtggacaattcggccatcagatcattaagaacttccttaatttagcgcgcacatatcgctggcaactcacggagaaaactattccgctcagcgttgattcagcagcggtttttgaaacattctttgcccattcctcccatgctttttggctcgatgatgcccaaggaaccagctatcttggtgatgccagcggtcctctcgcacgcacaaaaacccataatgtcggcgagggggatttcttcacctggctaaaggaggatctcgccgccaactcagttgcgcccggtcaaggttttcgtcttggctgggttggttacgttggttatgagcttaaagcggaagctggcgcacgggctgcgcacacttcgagtcttccggatgcgcacctcatttttgccgatcgcgccatcgcagtggaatcggatcaggttcggttgctggcgttgggggagcaggacgagtggtttgaagaaaccatcaagaagctgcataatcttgtcgccccgcggatacctgcgtccggacacctcgctttgcaggttcgagattccaaagatgagtatctcgacaaaattcgcagagcccaggagctgattactcgcggcgaatcgtatgaaatctgcctgaccacaaaacttcagggcaccactgatgtggcccctctggctgcctatctagcactgcgtggggccaatcccaccgcatatggtgcgtatcttcagctgggggatacctctattttgagttcctcgccggagcggttcatcaccattgattcggcagggtatgtggaatcaaagcccattaaaggcaccaggccgcgtgggcgaacagcgcaagaagaccaagaaatcattgctgagctgcgcagtaatcctaaagatcgtgcagaaaacttgatgatcgtggatttggtccgcaacgacttagcccgcggcgctttgcccaccacagttaaaacatccaagcttttcgacgtcgaaacctacgccacagtccaccaacttgtcagcaccgtctctgcagagttggggccacgcagtccgattgagtgcgtgcgcgcagcattccccggtggttcgatgactggtgccccaaagctgcgcaccatggagatcatcgatgagctggaggcagctcctcgcggtatttactcaggtggcttgggatatttttccctcgacggcgcagttgatctctccatggtgatcagaactctcgtcatccagaacaatcacgtggagtacggagtgggcggtgcacttcttgctctgtctgatccggaggctgagtgggaggaaatccgcgttaaatcacggcctctgctgaatttgtttggggttgaattcccatgacgtacctcgtgtgggacggtgcaacactcgtagaaggcgcgctggaatcaacacccacagttgttgattcctacctagccaaagaccaccgcgtggtgcgctgggatcttcatgaacagcgcttcgccactagcgtggacgtggacccgtgggattttctccacgcagtaagggaagcaattccacgccagggctcatggtttcccaaagttgaatggcatggcgatgatcttttcgcagtcaatattcgcccggcaccaacactgcgaaaggccacatcattgtggctttccgaagacccagatccacgcacacagccaaccattaaaggcccagacctagatgtgcttgctcaccttcgcagtcgcgccaacgataacggctgcgatgatgcgctgttgatcagcgcggatgggttcattctggaagctgccaacgccaccgtggtgttttgggcggatccacagacggtcatcgtgcccaggggagatgtgctcccatcggtgacactcgccgcaaccattccgctgtgggaaaaagccggaatcacattgcgctatcaaaacattcggcacattggttttcccgcgtggtgcggtagttcgctgcatggttggacacctgtggtcagttggggcaggggattgggcaaaattgcagcagcgaaagctccatcggtgaagccctggaatgaaaaattgcgcccaaccatttttctgtgaggaaaaggttgagcgcagtctttgtgaagatttagtcttcggtagtttcttcagtttctttctttgcggtttcgcgaccttcagcaagctgtgtgcgtgcggtgcgcaaccattctggctggttttccagaagtgccttgatctcggcggtggtcagtggtttgtccatgtcgttctttttcagagccgcgatggtgatgcccaatttttgggcgaccactggacgagggtgtgggccctcgcggcgtagggtttggagccactccggtgggttttcctgcaggttcttgaactcttggtgagtcaatgcacctgtttggaactcctctggcgtggcgggcaaaaacagtccgagcttcttagcggcggtctgtggcttcatagccctgcccgatggctggcgtacagattcttcgttcacgcccacaacggtagcattgttttcatgctgaccttaagtttcatcactggcacggagccaggaaagtggtttacccgattccgagatcggactcatcacggtggacttgagacccttgattcggacgacgccctaggcctcatgctcgctggccaggcacaactcgccttaaccaggcttccagatgcgcgtatcgacgcctccctccacgtggtcactctttatcaggaacaacccggagtcgcttttccaaaagactttttcctcagtgccgaagaaggcgcggtggaccttgcggacttagatggggagatcatcaactggtccatgcccgatagtggggaagtcgatgccgctgctgttcgcgatgctctgcaaatcgtggcagcgaacgtcggtgtggtgatcgcccccaggccacttctcaaggtgttgagcaagaaattggtggagcaccgggacatcaagggtggaactgaaacatctatcgccctggtatggaagaaagatgaggattctgaagagattcaagacttcgtcggtattgctcgcggtcgaacgcggaattccagcaggcagcaaacggtaaagctcagtgctcgtgaaaaaacactggcaaaacaagcccgcaggcagggggagaaaccaaaaactccgaagcgtccgcaggcaagaaaacgtcccggaaaacggcgataggggtcacccgcgcatgtccggttgccgatctatttaaataccaggacaattgcgtgcatggttgaaagagacttcactatccgaccaatccgcgagggtgatttccctcaggtgagggacatctacgaattgggcctggagacgggacatgcgacttatgagacttctggtcccacgtgggaccagttctcccaatctaaaatcatggataccgtcatggtggcggtagaaaacaacgacccggacttcatcctcggatgggtgtctgctgctccaatttcaagccgacaggttttccatggagtggtggaagattccatctatatccacccccagggccaaggccgaggaatcggcggcgctttgctcgacgcccttatcacctactgcgaaagcaacggcatctggtcgatccactcctggatcttcccggaaaacctcggttctgcgaaactgcatgaatcgaagggcttcgtgaaggtgggcaccatgcaccaaatggcaaggatgccctacggcgagatggaaggacaatggcgcgattgtgatctgtgggagtgcctcttatccgttccagagcaagctcaaagttcctaaagcaatttaaatctgactttatcgcccggcaacagctgggccgaacgatcacacgaccttgatgtaagtactgctattactggatagccaccggtcacaggatgatcgggaccaaacaccacggggtttccaccaggcggaatctggatggacccccggaccattccttcacttttcagctcgccttccacacgatgttggatcggctcgcttgagtgcatgcgcaaaccaatccggttggagtcattgctcaccgtaaacacctgagtaaaaaagttgttgagggattcttgcgtgaaccatttgtcacgtggacctcggatgacggtaagcgtttctgttggcatgcgtttccataaggtgggcagttgccgaagttttggccaccactgagaatctgcaatgtctgttgctacgtcaatgacatccccgggctcgatcgggcgagggcccatgtgggagatcagatcggttgaagcagatcccaaagttttttctactgcaaatccaccgcgagcagcaaagtaggcacgcatgccataggttgcgggctcgacgcggatacgttcaccagctgcaacatcgatgatggtgttggtggtggcatttttggattgtccaccagccgttcgaaccatcacttcagcttcagttcccgtgaacacgatcgaggtggtgtgcaacgcctccacctcaaagccaccgagcagaatctctaccacggttgcattgggatcattacctaaagcgtgattcgcgcgagcagcggataaacgatcaaaggatcctgaggttccaacaccagcgctggcaaaaccgaagcgacctcggtcttggaagatggcttgggggccagtggaaattactttgaagctcatttcttcacctgcacaaatcgaactgaatcaccgggcttgagaagcgatggttgccaccggtccacatcccacatgggaatctcagtagtgcccagcagttgccaaccaccaggggactgctgcgggtacacagcgctgaattcaccggccactgcgacagaacctgcaggaatcttggtgcgtggcgattccaagcggggaatatcccacaggggagtctgggggatcagatagtaaaaacctggtgcaaatccaccgaaagcagcagtccacacggtgccagaatgcgtggcgataacttcctccacgctcagacctgtgtgttgagctacggtttctagatcagggccgtcgtagaccacgggaatctcaatggtgtcggtaagctctgctgcgccctttgcggctggggtcagcgcaattgaatcaacgatctctgcgaaacgattcggggtgatctgcttggtgtcaaacgtcactaacagtgtttgcgcagcgggaatagtatcgatgattccagggacctgcatgcccaccaaagagcggttgagtgcaagaacagcatccaagatgctgccttggacggcttcggcatcttcagcaagcaaatcgatgatgactgcttgctcaccacatggcctaacgagcatgggaaacctgaacctcatgagctgcaagggtggtcacgattttctccaccaatgcgagagcttgcggattatccccatgaacacagatggagttggcgtcgacaagcacgctctccccggtgatcgcggtgatgggctggccggtggcaaacgccaaggcctgcctggctgcggtttcggggtcgtgcagtaccgcgccgggaagcttgcgggaaaccagctggccatcggcggtgtaggcgcggtcggcgaaagtttcctgctcaacttgaagccccacggcgcgggcctgctcgacgatttgggagccagccagggccatgagggagagctcaggattgaccagcttgatgccctcgatgactgctgcggcctgggcttcgtcaaccgcaatggtgttgtacagcgcgccgtgtggttttacatattccacaaccgcaccgctggctttagccgcagcttgaatggcgccgatctggtagatcgtttcggcgacgaggtcatcgtgagcgatgtcgaggttgcggcgaccaaaacctgcgatgtcgttgtaaccaatgtgtgcgccgatgcggacgtggcgtgcatgggctgcgcgcacagttttgaacaacacagtggcgtcgccggcatggaaaccgcaggcaatattggcgctggacaccaagtcaagaacagctacgtcgttgcccatgacccagctgccgtagctttcgccgaggtcgctgttgagatcgatggtggtcatgaaaaaatcctttcaaaaaacgttaactgctaagaagatcgaagactccaccgaaggagacataagccaagaaccatgcgataaccaggccgatgactcccactacgatcagccacactgggtatttgtaacccttgaggagatctttttggcggaagatcgctacgtagatcatcagggtaaagcctacggggaggaccaaaccgttgaatgctccggcgaagaccaagaggattgctggtgccgtgccgagcacgatgaacacggagcaagaaatcaggatgaagatgatggtcacccagttttgcagacgcttcttctctggcttgttttccaccaggaaggttgcagaggtgtagctggcgccgatgactgaggaaatggacgctgcccacagcacggcgccgaagatgcgtagtccgatatcgcctgcagcgtgctggaatgcttccgcggctgggttgcccgtggtggatagggtgacgccacctgcgacaacaccgagaaccgcgaggaagagcaccacgcgcatgaggccagtgatcaggatgccggtgatagaggaattggaaacagctttgacgttgttggggccggttcgtccggagtccagcatgcggtgtgcgccagcgtaagtgatgtatccaccgacggttccacccacaagtgtggtgatgacaagccagtcgatggtgtcaggaagtactgcattcttcagcgccgagccaactggaggttgggagacgaaagccacgtagacggtgagcaggatcatcacgacgccgaggaccacgaggaatttgtccagagcagcaccaagtcgcttgaacaagaagatcgcaatcgcgatggccgcggtgatcacgccaccaactttgacgtcccagccaagcagcgcgttaagcccaaggccaccaccggcgatgttgccgatgttgaatactacgccgccaatacagaccagtacggccagcacccaaccaaaacctgggataaccgtgttgccgagttcttgggcgcgcatttcagagacgccgatgatgcgccacacattcagctgcaccgcgatgtcaatgaggatcgacaccaggatcgcaaatgcgaaagctgcgccgagctggttggtgaagacagcggtttgggtgaggaaccctgggccgatggcagaagttgccatgaggaagatggcacccatcagagcgcttcggccagaggcggttactgcagcttgcttgagggatggcgcattggcttttgcaatgtcgccaggcccaggggttccagtgctggctgagactagctggctgtcatcggcatttttgttgtcggccattgtcgcgctcctttcgtgggggctttcaaaatgattggggtagattgcacaccaatcgcagattgttgaacaatcttggtgagttgagagtgagtttagacccaatgtgtcctatagcacaatcccgcgtggggattaatggtcatcgaatatggtcagagcacccccgcaagtgcctaggtgtgtccccagtcctttaagatcagtcacatgacgcaggcaatagcagcatcccttgatttagcggctcgaatcaccgccaaaattgatcaaggagtgctcactccaggtactcgactacccgaggttgctttggcagaagaacttggcgtttcacggaacacgctgcgtgaagcttttcgggtactcatgcaagacggactggtggatcatattcccaaccgtggggttttcgtgcacacgttcaccaagtcggatgtggaagatatctatgcttaccgcacatttatcgaggttgctgcgattaggtcggcgcggaaaaatcctcagttgctggagcagtctttgggggtaatgcgagaggcctacgaaaggggtgctgcagccaatgccgtgggtgattggcaaactgtcggttctgccaacagtgcttttcacttggcgattgtggacctagcaggagtggctaggttgtcagcagacgctcgaaaagtgttggcgctggctcgcatcggattcatggccacctacaacgtggagacattccatagcatttacgtggaaaagaaccatcaaatcttgaagtatttggctgccggtgaattcgaagaggcggaacaatacctccagaaatacttcgaagattcgcgcgatgatttgtctgcgcacctaccggaattttgaaattgcgatagcatagatgacttgacactgttgcagcaggcggttttcacctggcctcttaggatttggtcaaatggttgcaacgacgccagggaaggaggcgcaccccatggcatttggattttttagtagacgtaagaaaaagaacaaagacaaaaacccgaatgaaaattcagcagtgcccgcacactctgaagattcacctcaggaggtttttgagggtaatggtcgtcaggtaggcgaccccattgaacagcaggttgatcgagatgctaaaggtcgtctcacagcggcggatttcttgccggacgctgatctgccacagctgaatcgttcgcgtgcaaatatgctgcgccgtgaattggagtaccgtttttcactccagaatgcccacattaatatcgatggaaacacggccatgattcagcgttcagatggcggggcagcacatgtctcgttgcgcaccctcgcgatgaatgcagctggccttgataactttgatcaactccctgaactggtggaaagcttcgttcacggcacgctggccgatgcaacattaaacgatctttctactgctgacctgtataaagcactgcgccttcgcctgctgccaacacctggcgaaggcgacgatctagttgagcatggactcgaccgggaaagccagatccgcgacgattcaatcctgcgcaccttcacctctgacatgtcgatcgcgctggtgctcgataccgagcatgccatccgcatccagccactcaaagagctcgaggagttcgatgacctcagcgccctagagcgggctgcggaccgcaatacctggcaagagctttacgacgcaaacgttgacgcttccttcgtcgacgctgaatcagacagcgaagggtcatcattttgggctttcgaatctaactcgtactacttgggtagtgcaccactgttcctcaacgatctgttggcaaagtgggcacctgacctggaccaaagtgatggcgtcatctttgctgtccctgatcgtgatctgttgattgcgcgtcctgtgaccaccggcgaagatctgatgaacggaatcaccgcgatggtgaggatcgcgatgcgctttggcctcgggaacccgacgtcgataagcccgcgcctgcacctgctgcgcgacaaccaggtgaccaccttcaccgacttccgcgtcgtctctcctgaaatggaagctgaatgggaagacagcgcgtttgacgcgccaccggccggcgcgatcggcattgaggtgcgcccagatccgtatctgatggagcgcctccaacagggcggctttggtgatttcggagatttcggcaagccccgcgatctagatatgtagcgaaaaagggaccttcacttcttaagaagtgaaggtccttatttatcgggttctagttttagaacttgttctcgcgctcggtgtgagccatagcaagaacgtcgaggcgcttgtccagctcttcctcggtgagcttctcgccatcaaccaagcccaaatcgatgacagtctggcggatggtcttgccctcagccaaagcagtcttagccacctttgcagcagcttcgtagccgattgcagagttcagtggggtaacgatggaaggtgaagactcagcgagctccttcatgtgtgcctcgtttggctcaatgccatcaacgagacgggttgcgaacacgcgggaagtgttagccagcaggcgagcggactcaagcacgttgcgagccatcactgggatgaacacgttgagctcgaactggccctgggtgccggagaacgcaacagctgcgtcattgccgataacctgagcggaaacctgggtagcggtctcacagagaactgggttgaccttgcctggcatgatggaggaacctggctgcaggtctgggagacggatctcgccaagaccggtcagtgggccggagcccatgaggcggatatcgttagcgatcttgtacaaggagacagcgataacgcgcattgcgccggagaactcaacaagagcgtcgcgtgcagcctgagcctcgaagtggttctcagcttccttgagctccttgacgtcggtcaagttgatcagttcagcaacaaccttgccgccgaaatcagcggaggtgttgataccggtaccagcagcggtgccaccaatagccagctcaccaaggcgaggaagagtagcctcaacgcgctcgatgccgagctggatctggcgagcgtagccaccgaactcctggcccagggttactggaacagcgtccatcaggtgggtgcggccggacttaacaacctcagaccactcgttagccttcttcgccaaagactcgtgcagaaccttcaggcctgggatgaggtcattgacagcagcttcggttgcagcaacgtgagttgcagtagggaaggtgtcattggaggactgacccatgttgacgtggtcatttgggtgaacctcaacgccgttagccttcgcgatggaagcgataacctcattggtgttcatgttggaggaagtaccggaaccagtctggaacacatcaattgggaactcagcgtcatgcttaccggacgcgatctccttaccagctgcaatgatggcatctgccttctctgcatccagcgcaccggagtccttgtttacctgcgcacaagctgccttcagcagacccattgcgcggatctgtgcggattccagaccacgaccagagatagggaagttctcaacagcgcgctgggtctgtgcctgccacagagcctttgctggaaccttcacttcacccatggtgtcgtgctcaatacggaattcctgctcggtcatgaaatcactcatttcttactgagaattaaatacggctgtcacaagcttactcattgtgttgtcgcgaaacactggagtccacccctagagtgaggtgggtaatagaaagtgtgagaaataaggcacaatccactcctaaatgtgggggtgcaggcttgtttaacgtccaaaattcggcggtaggtgtacctaaaaacaggggtgggaaatacttggggattgctctcatcggttcgatatagactgaattgtctaggttaatatccaatatggaagaaaaactagacagttaagtagactgaatggcctactaggtgcatgacttcagcaatcaccaccgcaactgatcttcgctccgtactgcgaaacgtaccaaccccaattagcttcattgcaacccacaccgatcagcctctgggcatgatcgttggttcattcgtcagcattagcgccgaaccaccattggtaggcatcttcttgcagaagagctcttcttcatggccagctatcgagcaggcattagttaccggccaagagctaggcatttctatcctcggcggggcacacgcagaccatgtgcgtaagctttctggcccatccgaccagcgctttgaaaaccttgggtgggcatccaccgaaaacggtgcgattcaccttgaaggcgctgatgcacaactaaccacgaaacttcatgatctccaggaaatcggcgatcacttctttgcagttctagaagttattgacgcttccgctgaccaagacttcagctcagcgctggtgtaccaccgctcacaggtgtcctcgctgtaggacactaaattttaagagggcgcgtcgaatcttcgacgtgccctcttttaaaattcgtggaacgctttgtggtgagtgtggagactttcctcttgttcggtgttaagtggttcgcgtcctcttttctcgcgaatgattctcacgtgattgataaaggcagcggagtcagggttttcgattgcggttttaagctccattccgtacagtttttgctcttctgttgtgaaataatctgttctgttgcggaagtccagtcccataagttcaaccagtgcgtcatcggataggaaaccgttaaaagcccaactcatggattcgtcggtctagggtctgtggggatcgagggtgtcccattgcttctttctttccccggaaacgtgccagattccatcctcaaaccaggtcacagatgacggtgcatcgccaataacggaaccgcggtaaggatagaaatcctctagagaaacaagacccgtccattctggggctgcgggagaaatgtggagatgtcctttttctttgctttgaaaagggctgatatcctcccaatctgaaccaatgatcagccagcgttcactagttgtgctgctcggaaattttcggataattacgcccgaaaatgcctcatcgtcgtaagtgaataagcctggtgttgtgggtgtccatgcagggcttggagtagagcgatgggcgtgttctgcaaggagttggatgcgcaaacgggtgaggatttggtgaaattcttccaaaggggtgtgcgcagaaagctccaaggggtggtgggcaaggtctctcgggtgatcttagtgagaatacgaaaagaggcgagtcccaatcggggagctcgccacttttgtgaggggtttttaagttttagacgttcgcagactcgcgaatggtggacattgccttggtccagacaacaagctgctcaagcatagcgtccacagaggagatgccctgctcggaaggcttgaagttagggtattcgaagtcggtgaagatgctcagcaggccggtcttttgaacgtgtgcgatctgaagctcggaaaggatgccgcggaggtgctcagctgcgcgaacgcccattgcggagccgtaggagacgatgcctgcagccttgttgttccactctgcggagaggtaggaaagggcgttggttagtgctgctgggacggagtggttgtattcgccggtaacaaagatgaagccatcaaattctgcgatctttgctgcccatgccttggtgtgctcgtttgcatactggccgtagccggctggcattgcttcgtcgaggacggggaagttgaaatcggcgatatcaacgagctcgtactgtgcatcgttgcgctcttgtgcgcgctcgagaacccagttggctacgtcaatgttgacgcggcctggacgggtggaaccggtgatgatggcgatcttgctcatggtgtactcctctaaaagttaattaagttgatgtatcaacaacttgacgtacctagcctatgttaactttccgcgtcatgcaagcgctttgggattccagtctatttctcaaggtcaacagggtgggggagtcgtcgaggttttcattcagggtgaatgctctccttgtttcagatgttcaacgctccataaagtagaccgcaatctagacaaagatgtctattttaattaaggagcagaacatggccacggccgagaacacaacacaggagaatcggaaaatcctgttcaacgcatttgatatgaactgcgttgcgcatcagtccccaggactgtggacacacccgaaggataaggcgcgagactacaacactcttgattactgggtgcaccttgccaagactttggagaagggccttttcgacggccttttcatcgcagatgtgcttggaacttacgatgtttatggttctagtaatgaagcggcgttgagcagtggtgcgcaggtgcctgtcaatgatccgatccttcttgtttctgcgatggcctatgccacaaagaacctcgggtttggcattactgcaggtactgcctatgagcacccgtatccttttgcgcggcgtctggccacacttgatcacctgactaatgggcgtgtggggtggaatgtggttactggctatcttccctctgctgctcaaaacatgggtgacaccgatcagctgccacatgatgagcgctatgacaaagcagatgaatacctggaagtgatctacaagcttctcgagggctcctgggaagacgatgctgttcaaaacaatacggagacgagtgtctttacggactcctccaaagtgcacgccattaatcatcatggcaagtactttgatgtgccgggcattgccatcactgagccgagtgtgcagcgtacgccggtgatctaccaggcgggtgcatcgccgcgcggattgaaattcgctggtgagaatgcagaagcagtgtttatcaattccagcaccgtggaggcaatcaccaagactgtcgcaaaaattcgcgctgctgcggtcgctgcgggacgtgatccacatgcggtgaagatctttgcgatgcaaaccatcatcactggtgaaacagaagcagatgcgcaggcaaagctggaggaatacagtcgctatatcgatcctgtcggtggtctgaccttgatgtctggatggaccggcgcggatctgtcgcagtatgacctggatgaaccgatcaccaatattgagtcaaacgctattcagtccactgcagccaccattagcaacggcaccggtgaaggtgcgtggacggtacgcaaactgggtgaggcaaccggcatcggcggcttcggaccagtgcttgtgggatctggcgctaacgttgccgcggaacttgcacgcatccaggatctcagcgatgttgatggtttcaaccttgcttatgccatcaccccaggaacttttgaagatgtcgtggactttgtggtgcctgagctgcaaaaacttagccgctacaagacggaatacgcgccgggttccttgcgcaacaaattgctcggtaaaggtgatcgcctggacgatacccaccgcggcgcaagctaccgcctaggcgctcggaactccaccgccactattgatctcagttccatatccgcccaactagtttcccagggagcccactcatgatctcaccgcaaacaatcatcgacaatcttgctccagtcctcgcggagatcgcagcaacggctgcgcagcgcgaacaggatcgagaattcagccgtgatttggcaaagcagcttagtgccggtgggttcactaaactccgcattccagttgaatttggcggtttgggttttagccttccagaagcatttgaggtgctggtggcagcggccgctgcagattcaaatatcgcgcagggattgcggcctcacttcttggcagtggagagcttattgatcgctccttattcagagcaccgcaccaagtggctgcgaaaaatcgctgagaaaggcgtggtcattggcaatgcgttgactgaagtgggaaacaagccaggtgagctgaaaaccaagatccgaaaggaaggcgagtcttacgttctcagcgacaccaagttctattccacgggcagtctttacgccgactggattcaagtacatgcgaaagatgaggaagatcaagatgttttcgcctttgttgatcgcgacgcatcaggcgttgttttggtggattactgggacgaatttgggcaacaactatttgcctccggaaccagcttctttgaaaaagtcgtggtagatccactggacattgtcacccgtgattacaccgcacccagcgctttccaggcgctggcgcagtcacatcatttgtctacgttgactggtatttcgcaggcaatcacccgtgacattgttacctatgtacaaaaccgcacccgtattttcagccacggaagtggtgaccttccacgctttgatccgcaggtgcaacaggtggtgggtgaggtgaaagccaagtcgtatgcagtcgagaaaatctttcagggtttcgcacaagaactggatcttgtcgtcgataaggcaaaagccggcactgctacggaggtcgatctggccgctgtcgacctgagcgcctaccaagcccagttagcggtggcacctttggtgctgagccaggccacccaggcctttgaggttggcgcagatgccttaaacggcggccacgtggctgcccaatacacgatcggatccttgtcatgagccaagaaattttgagccattttgcacccgcattagagcgcattcgaagcggcgccgtcgagcgcgaacagcagcgcgccttgccagtggaagagattaaagagctggtagagctaggttttactgggcttcgagtgcccgaagaactaggcggtgcgggcgcttccctggaaagcgtagttgagttactgatcgagatcgcgggcgccgattccaatatcgcccaagccctgcgcggacattttgccttcgtggaactactcctggaagcgccggagagcgaattccgcacccattggctgcgcgaagtcgccaccggaagacttgtgggcaacgccgaaagtgagaaacgcggcgtttacggcgatccgcagaccttcatcgatgaggtggagactgaaaacggaccgattttcgtgctcaacggcactaagttttataccaccggcacctattttgcggactacacctggaccaccgcgctgctgcgcaacctcaacggccaagaaactttggtcagtttgccggtcgatctgcacgcgccgggcgtggatgttgttgatgattggagcgggtttgggcaaaagctcaccgcctctggaacgaccacgtttaaagacctggaggtggatccgcggtggatcattccacgcactgatgcgcccacgctggtgtggacgtatctgcagctgagcctgctgaccgtgctggttggcagtgccgcagcagctgtcgatgaggtggttgcccgcgcccaatcctccaccagaaatgcgtggaaccctggcgtcgagcgccgcagcgatccggccgcaaccatagcgatcggcgacgcacgcagccgagtcaccgttattcgtggagcgcttctcgacgccacccgccacgtttccaacgccgccacgatcgtaacccccgaagccttcaacgaggcggacgctattgttgcagcgctctggcccatcgtctccggacaagctttggtggtgacatccaacgttttcgatgcggtgggtgcatctgcagtgcttggtgagcattccattgatcgccactggcgcaatgtgcgtaccgtgtcctcaaacaacccggtgttcctggccaagaatgcagtgggggagtatgccctcaacggcactcctgtgggtaccaacattggtaaagcactgagccgtccggtgagcctaagcagctagacgtgtgatttcgctggtttttagatggttttcaagccagcgagaccacattagtttcacgctggttgaaacctttgagatcaatatagaccgtgtggtctactcgaggaatgagtgaaaacaatcccactaccttgcactggttcctacccacctatggcgattctcgcggaatcacagccggcgggcatggcttcggcttccactccggaagccggacagcagacctcgattacctctcccaaattgccctggccgctgaacgaaacggttttgaatccgtcctgactcccactggattgtggtgcgaagatgcgtggatcaccaccgcagcgctgctgtctaggacatcaaaactgaaattcctcgttgctattcgaccaggccaagttagccccaccatcatcgcgcagcagggtgctgccttccagaaattctcaaataaccgcctgctcatcaacgtcgtggtgggtggcgaagaccatgaacagcgcgctttcgctgattattcttccaaagaggagcgctaccacaaggctgatgaaaccttagagatcatcgatcacctatggaacagcgcagaacctctaaatttccagggtgaattcctcagtgtggaaaacgcggtattgaaggaacagcccgaggtttccccaccgatttactttggcggatcctcacaactcggcatcgaaatcgcagcccaacattccgatgtttatctcacctggggtgaacctgcggaaaaggtagaggagaagcttgcccgggtgcgcgccgaagcagataagcgaaaccgcgaactagactatggcatccgcctgcatgtcattgctcgaccaactgaggatgaagcctggtcagtggctcaaaatcttcttgaccaacttgatcaggaagaggttgcccgcattcaggaagggcttgcgcgttctcaatcggaaggtcagcgtcgcatgacggaacttcatggacaaggggcagcattcacagcaggagcagatgctcgctcccttgaaattgcaccgaatctctgggcaggtgttgggctagtccgcggtggcgccggcacagcgttggtgggttcctatgagcaagtcgcgcaagcaattttgcgataccgcgatattggtctgagccacttcattttctccggctatccacatttggaggaaacctatcacgtgggcgaaggagtggtacctgagctcctcaaattgggtgttccggtgaacaaccatgaagaacaacgcaacgacgtggtagcgactccgtttatttccagatagatcacggatcggctgctttagcagaggcaaaagccgggattcagttggtgcggcttccagaggttgtcacaaaccgtcttatatgaccaacggccaggagatgtgaggttggtcggtcacctagtttggtcggtgcttggacgccagaaaaactggccgggccccaccaaaagtgacctctcagattcgcctctaagcgcccaaagccctgaaccatacaaatactcaatcttgatcttcgacctcttaaatcgcatttgcactggcatccctcgtagggatccccaagcaaaaaaccgccgaccacaatggccggcggtttttcgaactaagagctcttaggtcgcggtggtgtagtcaaccacggagtattcctgcagcttggacagctggtggacagactcgatgtggcggatggtgcctgactttgcgcgcataaccagggaacgggtggttgcgccgtttgcgcggtaggaaacgccacggagcatgtcaccgttggtcacaccggttgccacgaagtagcagttgtcggagctcaccagatcgttggtgtgcagaacctgatcaagaaccagaccagcgtcgtgtgccttctggcgctcgaaatcgttcattggggccaggatgccctggatttcgccacccatgcacttcatggcgcacgcagtgatgatgccttctggggttccgccggtgcccatcatgatgtccacggagttggaatcctgagctgctgcaactgcacctgcaacgtcgccgtcggagatgagacgaacctttgcgcctgcacgacgaatgtctgcgatcagttcgatgtggcgaggacggtcaagcacgacaacggtgacgtcggaagggttgattcccttggactttgccaccgcgttgatgttgtgggcaactggagcttcgatgtcgatcttgcctgcggcctcaggtcccacggcgatcttcttcatgtagaagacggaggatggatcgtacatggtgccacgctctgcagctgcgagaatggaaattgcgttggggcgaccctcagccatcagggtggtgccgtcaactgggtcaactgcgatatcaacctcaggtccaaagccggttccgacctcttcgccgttgtacagcattggagcttcgtctttttcgccctcgccgataacaacgacgcccttcatggtcactgagttgatgagctggcgcatggcgtcaacagcggcaccgtcgccttcattcttcatgccacgtccaacccaacgtccagaagccagtgcagctgcttccgtaactcgcaccagctccatagcaaggttacggtctggcgtttcggggttctttaggttcatctgaagggcctcctggggcacttgatctgacctggttacgtgggttgcacgtatctaggcgcattataaatgtatcggcgcttgggctgtatcaacccgcacgtcatctattgttgcacttttgtgcccggaattttggattctggacacccaaaagggggtttcgtaccaaactcgtgacatactaggcgggtggctgagaaacgaccgaaaatttttgatggcagtcgagacatgattatctcgttggtagtctccgcgatcatcatgttggtagcggtgggattcacgggaatgtgttctttcaatacaggatcccctgaaaatgggcaggtacctgaagttgatgcttccacttttatgtcaatggaagcgcgcgcaatgactgatcatgcaactaggttgccggaaactcctgaaggctggaccacaaattcagctcgacgcaccatggtggatgacaccccggcatctgtagttggatatgtcaccgcagatgagggctatattcagctcactcaaactggtgaaaccgttgaggatgctgtggctggttatgatactcgctggcgtgatctttctgagtcttatgatcttgatggccacgacgtgggaatttacacctcacaggaatctgatgtgcgtgatctgcgtgtgatggatctgggcgatgcccgcgtcatggtctcgggtgctgctaccgatgaagaattcaatgatctgcttcgcgcagttgcgaattcggagccactgcctaccaattaagaattggtcgaaccaccaaaggtttgtgaattaaatatagaaagtccggtgactctacacagtcaccggactctttatcttttagggcttaattctttcttctcagcgcaaagatcaaaccaatgattatgcctaagccaatgacacccagcccaatccacacgatggggaaactgcttgagtcttcttctgttgcctcggagatttgttcatcttccgcaacatctgatgggggggtggaggtgcttggggttgctcccgtcaatgaagcgaaaaccggtgggtcaacagggtctccaaacgcttctgccacgagttcatattccaatgtgggcagctgatcagttgcggatacatcttcatcttgaccacttggtaggtatgtcactgcgaggtattgggtgccaccttgccatgggctccttagcgatatgccttgagaacttttctcgaacaaatttgctgcactcactggggtgaagaatccaaaagttttgagcccgttgtcgtccgcatatgacgtatctctattggtgagctctatctctgcccggtttgggctgaacgcttggatataaagatgcgtgccaagcgcggaactgtcgatttggtcaaaagttgtttctacagctgcgcgcagttcttggccgtagtcgacaggcagcgcatagaagtgggtttctcctggaacgatgatggaggagactttctcacctgcgggatctagatcagcggccgatgtgaaccactggccaggtgtgacagggtgtgcctctgatgctgcagcctcggtaagatcgacggagctatgttcctctgtgacatttccgattgttgattcatctacttttccgaagcgctcgatggtgatttccgttggaatgtcctgcccgttgaggtaatctccgcttctagaaatttcgaggtagatggcatcggtgtcacagttgttggtgcccacttcttttgatgcaacggacgcgttttggattccgcgtacaccaaggccgggcttgaaattatcaaatgagacccgagtgcaccgaccacgcaggccgtattgtggagcctcttcagtatggagttgggcttcaagcttgattccgccttgccccatggtgagtactgttgggtcggtaactgtgttggcagaaactgagatggtttcacctggctctacagggattttccaaaagcgggattcttgtggcaggtcggtgaggaatagttctgtatcctcatcaatttctacggctgcgctttgttccgatgccccatcaatttttgtcacatcggaggtgtaagagttgtattgcctactggcggctcgtgtcagcgcatcggtaaggctctgcgcgtcggaagcatccgcgtaagtgccaccaccgactccagcgatgcactccagttcttcgcgcgctgctggatcaacatttagtccgatggtgttgataaccaggttgattccactttgagccagttcttgggctacttcgcagacatccggtggggtgcagttggcgatgccatcggagaccaacacaatgtttccgccttcggggagctcggcggcggtatcggtgagtgctttgccgatgggggtgaagcctcgaggctgcaggctgttgatcgtgtcaattaaggtgtctgcatttcctcgggaggggccgccaaggatggtgacgtcttggcatcccatctcaacgtctgcttctgtttcgccggtgtttccgccgtagtaggtcagacctacgtcggtgcggtcggagatgtcattaattaactgagtggaggcttgttttgctgcatcgatacgggtctgtccgccggcatcttgagctgtcatggagcctgaattgtccaacacgatcatcgtcggagtttcattggcttgggctttggctactggggaaagcgaaaacgccagcgcaactatgaaggcgctggcgagtgcttttcgtatgctgagacgcttgctgagaggctgagacactgtggctcctaaaaagggggctgaaggtgtttcaaaataccgtactcaatatatgaggctccgcaattagaagagagaaattatttattgggcgggctggtgctccacaacgctgatggtcgcttgggtgccttgcgcttttcgacgcaaaaccacagccacgatggccaacactagtccgagggacgtcatcaaaccgccaactaatccggctgatgtgagtccaagggaagtggtgatggttgcaccagcaagccaggcagcaacagcatttccaaggttgaacactccgatgttgatggaggaggccatgccaactaatgaggcctcactgcaagcagtgctggatcaattgcgcaatgaaccggagttagcgccgttcattgaggtgatggaaaactagagggatgcgtcgaaaagcattattctgcctggtttaatgcttgctcgacgcgcgctgaggcgccggccaggtgctcttcgcagcgctttgctagggcttcgccgcgctcccagtatttgagggattcgtcgaggcccatttggccgagctccaaaatttttacaatttcaacgagttcatcgcgtgcacgctcgtaggataattgggcgactggctcgaaggaatcgttgccttggccggaaccgacgatatctggattggtcatttcttcattctcctaagtttttagtttgcttgctgggtgcccatggatgccgcagtgatggagccgtcggcaacgcggatgcgcagctggctgccgggcggtgattgctcgatggtggtgaccacttccggggcgctgccgtcgcgaggaataacctgcaccacggaataaccgcgcgccaaggttgcggacgggccgagcgcggaaacctgtgcgcgcaacgacgccaccagtgcttgctcggtgcggacgagatgggtgacatcgcgcctaatcaagcccacagcctgggcaatctcatcacgtcggcggttaatcggggtcatcggatcagccagcaccggcctggtgcgaatcgctgccaacgcctgctgctcgcgctgcacccaaccgcgcaacgccgcggcactacgactgcgaagctgattgatcaacatgcgttcttctgccacatcaggcaccacgcgctttgctgcatcggtcggggtcgccgcgcgaaggtcggcgacattgtccaacaccggcgtatctggttcgtggccaatcgcggacaccacgggcgtctgcgctgccgcgactgcgcgctgcaaggcctcctcagagaaggggagcagatcctccacagaaccgccgccgcgggcaatgatgatgacatccacgcgagggtcctgatctaaaacccgcaacgcttcgatgatttcaggaacagctgaagcgccctgaactgccgtgttgatcacctcaaactgcacttccggccagcgatccttagccacgctcagcacatcgcgctcagccgctgaaccacgtcccgtgatcaaaccaacgcggttgggcagaaatggcagtcgcttcttccgagctggatcaaaaagaccctccgcggcaagccttttacgcagctcctcaatgcgcgccagcaactcaccaatacccacgggacggatatcagtcacccacagcgaaaaagtgccgcggcctgcataaaacgcgggcttgccgtacacaatcacgcggtcgccatccttgagcggtgtggggcgattgcggataatgtccgtcgggcaggtcagctgcacagacatttcttgctccacatcacgaagcgtcaaatacgacagcttccaattgggcttcacattaatctgagcgagctggccctccacccacaaatggccaagccgttcaatccactgcttgacttgagtatttacttcccggactggccacggtgcctcaggggttgattttgatgaagctttctcagacgacacaggcgtgtgattctccttcttccaccagctaaaagtgaattaccccgcctttgtcggggtggttgcattcccagtctaggtgtttagcctcaacgttggatacgctgggaggcatgagctcacctgttatcagccccgaaaccaaaaccggaaagaagatcctgcttgcagcccctcgcggatactgtgccggcgtagaccgtgcagtggaaaccgtcgagcgcgcgctcgaggaatacggcgccccaatttatgtccgtaaagaaatcgtgcacaaccgttacgttgtggacaccctggcagaaaagggcgcgatttttgtcaacgaagcatctgaagcaccagaaggtgccaacatggtgttctctgcacacggcgtgagcccaatggtccacgaagaagctgcagctaaaaacatcaaggctattgacgcggcctgcccgctggtcaccaaagtgcacaaggaagtccagcgctttgataagcagggattccacattctcttcatcggtcacgaaggccatgaagaagtagagggcaccatgggtcattccgttgagaaaacccacctggttgacggcgttgctggcattgccaccctgcctgaattcttaaacgatgaaccaaacctgatctggctgtctcagaccacgctttctgtggacgagaccatggagatcgtccgcgagctgaaggtgaagttccctcagctgcaggatccaccgtcagatgatatttgctacgccacgcagaaccgccaggttgccgtcaaggctatcgctgagcgctgcgagctgatgattgtggtcggttcccgcaactcctccaactcggttcgtctggttgaggtcgctaagcaaaacggtgccgataacgcctacctggtggattacgcccgcgaaatcgacccagcatggttcgaaggcgtagagaccatcggtatctcctccggcgcttccgtgcctgagatcctcgtccagggcgtcattgagcgcctggctgagttcggctacgacgacgtcgaggaagtcacctccgccgctgagaagattgttttcgcgctgcctcgcgtgctgcgccacaagaattaattgcaagaatgaaaaatccccgccacatgagcggggattttttagctgtacagatcatcgtcgagcgaggtgcggcgtttaggggctgcttgtcgacgctcacccacatccgtaggagccggcgcctcaggggcgctcgggcgcggcttgggggccaccacaggacccggagttggagtaaacggcacaccgcgctcagtttggcgctgcgcaacagtttgccggcgctcctggctacgcctgatcaactcatcaaccgtgacttgtgaaccggtatcgccggttggttgcgcgcgacggttacgtgttttagaactttgtaccctcgtgctctgtgcgcgagcacgacgagcagcattctgattagcttcctcagcctcacgctgcgcgcgccgggtaagttccccagaaacctgacgagattcctggttcctgcgcagcagaataatccgcaccacagcgatcaatgccgccaccaaagtgaccatgatcagggtggggaacaactgcgccaaaggataaacagccgtgaggatttccgtgacggaaacaccaggggacacattcgcagccacgccttgttgggacacaaaccacgaagtcagtggtgtgaaaataccaaacagaatgggaatggacgcaaccgtcaagaataatccgcgggcctcaaccagcaaggtcacaccgagagtagcgatgatgaaaatcagctgatagggcagcccgatcacgcctaacatcaggctgacgagcattcccgtaatgagggatgccaaaacaactgaaggtccagaccacgttggcaaaccgacaaaagcggtctgctggggcggcctagagcttctcctcgacgatgctgatccatgtgacacgagtgattactttaccgatctaactgctatttactaattacacttgcagtttctgcagcttttatggagcctcagtttctcttgcgtattttatcgaatgcttgcgaagttgccgtccttgccgaggtaaaccgtcgtttcaattctttacgacgaacctcattaggatctaccgattcacgatcctcacctaaaaactcaggaattttcagttcgttggtctcagcgtcgccaccaagcaagtcttggtagtagcgcctgcggaagatttcaccatcggcttccatggcacggccagcgaactcgccgtattcgctttcaaacttcagatcagaagccaccttctcgccagcacgtagtgaagtcatgtcctggaaatagcggaagaatacagcaatcatcgcagccactggtactgccaagaatgcaccgacaatgccgaagagcgtgccaccgacagttaccgacagcaacacgatgacagggtgcaaattcatagcctttgactgcaacagtggtgacaaaatattgccctccagctgctgcactgccacgacgataaccagcacgatgaccgcttcggtaaagcccagcgagactaatgccacgagcactgccaacgcacctgcggtgaacgcaccaatgatgggaatgaaaccagcaacaaaggtaatcaccgacagcgccaacgccatgggaacgcccacaataagtagaccgatgccaatgaacacagcatcaaccgcagagaccagtgcctgcgcacggacgaatccagacaaggtggtccacgcacgggtgagcagctcggtgacgtgccagccagcttgctttccaccaatcttcctggtccacgggaggaaccggtgcccgtctttgaggaagaagaatgtgagcaccaacaccacaccaagcgtcacgatcacactggttgcagcgcccaggcccgagaagatttctccagcaatggcacctgcctggttttgcagccacgcggcggcctcgttgaagtagcggctcaaatcacccgaatccaagttcaacggtggaccctgcagccagagctgaatgctcaaaatgccctcaaatgcctggaagtacaacacctgggattgttgggcgatactcggcgcaattaaccacaaaatagcacccacgacggcaaaaaacgtgccgatggtgataaacgccgacaccacactgggaactccatgcttccgcaaccatgagtttggtgaggacagcacagtacagatgatgattgccaaggtgaccggcaaaacgccctgccagaaccgaccaatgacccaccataaaataaagacagcggcggcgacgaacaccaaccgcaaactccacatggacaccctcttgaagtaatcacctatgaccaccgagcggtctacgcgatcaattgcatcccggtgccgagcagaagttttgcttggagtcggctctgcactggcagacttaacgggttcgccatttttgtcgtctctgatgccatgttggtcaccgtcagggacctgagagaattcatccattgttgccacagttctccattttgcatggttcttggttttaaagcacgaaacactcccagcgactgtggcgggagtgtttcctacagagatctttaggccgttgcaggtcgttcagactcttgctcaataagaacagagtcggtggcatatggagaggttccaaacagtccaaccttctcatctggttcgcgtcgaagtgcgatggtggcataaaccaggccaccccaaatgatgaccatgaacaacaccatcatgatgattgcagtagttcccatgatttaggactccttagcttcaggattggtgattgccacggtagggaagcgtgatgcatcctcattggcatcaaaaggactgatcgggtcattggacgcccagcgacgcgggcggtgcagcgtacgcttgaactccggcagaacgccgaagtcggagccgggtgggccgtcgacaagcgtgccctttggccaagaaaccatgggcaaaaggaatgcagccaccaggatgacagccagcacgccccagccaaagaggccattttgcagcacggtataaccgccgtaaggctcattgatcagggaggtgagctcaagagcaagggtggagcccagaaccaaggtggtgatgttgacaacggagatgcgccaaatggtgttcaccttgaatgcggagatcgcgttgaggtgggtggagaattcatcgatgcgacgcaggacccagtcgatggaaaccactgcgatcaacgcaacggcaacaatgccgatgttgttggtgaacttgtccatgatgtccagcgttgccagaccagaggtggtggagaacagacccagggacagcagagccatgacaacgcccacgccaatcgcagtggctttacgattcagaccgaacttatccttcactgcggaaacaaccacttccaacagagagaacagggaagtaaagcccgcgatggtcaatgagctgaagaagaggaatccgaacagtccgcccagaggcatttcgttgatgatcgcagggaaagcaacgaaggcaaggccaatgccggaggtcgcgacttcatccacaccaacgccagcatttgcagccatgaagcccagcgctgcgaaaacaccgataccggccagcacctcgaaagaggagttcgcaaaaccagtaaccaaaccagtgctggtgaggttggtgcgaggcttcaggtacgaggagtaggtaagcatgatgccgaatcccacagacagtgaaaagaagatctggccgtaagcagcgatccacacggtcgggttcttcagagcttcccagttaggagtaaacagcgcatccaaaccaatttcagcaccaggaagcaggaccgcttggataaccacaatgaggaagatgatcaccagcaacggcatgaacaccatgctcacacgaccaatgcccttatccacaccgatcgcaagaaccacaatagcggcgatccacacaataaacagtgcaatggcgatctgcggaacgatatccatggacacaactgcttcagaatcaaagttcaagaagtcagagaagaaataggtgtcaggatcagcaccccacgccttattcaaggacttgaaagcataaagcccagcccagccaatgatcgcggcgtaataaatggtaatgaagaaagcgattccgacctgaatccagccgatggtttcggtttgtttcttgaaacgtcggaaagcaagaggcgccgaacccctatagcggtgaccgatcgcgaaatcgagaaacaacagcggaatacccgcggtgagcaacgcgatcgcataaggaataaggaaggcaccgccaccattgtcataagcgacataagggaagcgccaaatattgcccaaaccaaccgcagaaccaatagcggcgagaataaagacagaacgggatgagaaaacttcgcggcgttcgcccttctgaggggacgtcggaggcgtatgttgtggagctgacatcttaacgagtctccagtcatgcacaaaggaccaataagaattccccaagcaaaggaacagtcctgtgtgtggtccgaacctgatgctctcctcgttctcagcctgatgtggccgcaatctggaaaatggggtgactaaaatacaactgaaatgatcttaacagtgatatagggaagaattcgcatggatttccatgctgtgtacgaaatgatgcaaaaaccgcaaaaacgcgctgtcactgcaaggagtgatagcgcgtttgttatcaaacgaataaggccagtgctctagtaaagagcgtgcttgatcgcatcccagccaggctgtaactgtggattaaagttgcgccaattgtgcgttccggaatctttgtagtccaccacttgatggttcatgccggccctgctcatcgactcatccaatgcctctgtgcagctcagcgaaccacgctcaagcactacgccagccagcaaattgtagaaaggctctttctcggaatccgccaaatcgatgtcatctacaactccgttcgcagctgacaaatagacagccatgtcgcgcagcccctcaggatttgatgtgacatcgtgagctttccaagtttcagaaccagtgggaccccacatattttctacattgccaccgcgagaattaacaattagtgacaccgtggtttgtccaatgggatcaagcgtggagtagcaaccagagatgccaatgactccatcaaagagatcagggttcgagttagctaaatgaaccgcaccagtagcacccatggataatccgccgatgccacggtgaccattgaagttcagctcttcctcagcctcaagcaggggcgcgagctcctcgacgataaaagtttcccacttgatgcgccctagcgcagggtcctcttccaaccaatccgagtacatggatgaagcagcacccaacggcattactacagtcacattttcatccgcgaaaaccttcggaccctcgccaccattgatccaaccagaagaattcttatttccgccgattccatcaagcatgtacagcatcggagcaggggagtccgcctccgcggacttcatgatctgcacatccacattgcgctgcatcgaaggcgacgcaacagaccatttttccagtcgaagaccatttaaaacacgcttttcgacgattcttgcctcagtaatcgaggggtctgtctcgagcggatagttggaatcactactcaagagcgggcctccaagaggcaactgggacgaaccaatcagcgacatcgaactcagcaagccttcaacagaaccgccagtgagatctgggttggcagtagaaagcgcgatgaaatcctgggcggaagatccggattcggagcttttctcaaagtcctgctctgaattagttgctgagctgtcttcggaacttagtactgaactgagtcccgagctctgtgcggaagcgagcggtgaagagaaaagagtcaaagaaacagtaccggcgatgagtgcgcgggatatgaagagcttcaaggaaatgatgcctccggcaacaatattaatgaataaaatatgatagataatgtagcagttgttcgtgcaagggtgtaatggccgccagttatgtgaagcgaaatttcacctttttggaggcagtcgacaatgctctgggcactgttttgtgcctcctgattaggttcttacccaacgattgctaggatatgtgcctgtgacccttactcttggaatcgtcggcctgcccaacgttggcaagtccaccctgttcaacgccctgactcgcaatgacgtgctcgcagcgaactacccgttcgccaccatcgagccaaacgtgggccttgtcgagcttccagacgctcgccttgaacgcctttctgaaatcttcggctctgagcgcatcctgccagcaaccgtgtctttcgttgacatcgccggaatcgttaagggagcttccgaaggcgaaggaatgggcaacgctttccttgccaacatccgcgaagcagacgctatctgtcaggttgtgcgcgcattcgctgacgaaaacgtcattcacgtcgatggtgaagttaacccagcaaccgatatctctgtgatcaacaccgagctgatcctcgccgacctgcagaccgtggaaaaagcactcccacgcctcgaaaaggatgcacgcaaagacaagggacttggcgaagtcgtagatgagaccaaaaaagcccttgcgatcttgagcgatgaccgcaccttgttctctgcagcaaaagctggcgacattgatctggccctcctgcgcgatctccacctgatgacagcaaagcctttcctctacgtcttcaactccgacgaaaaagtgctcaccgacgacgccaagaaggacgaactccgcgcactagtcgcgccagcagactgcgtattccttgacgcacaaactgaaaccgaacttcttgaactcgaagaagacgaagcagcagaactcctcgaagctgtaggccaaacggaaccaggcctacactccctcgcacgtgcaggatttgaaaccctcggactacagacctacctcaccgcgggtcctaaggaatcacgcgcctggaccatccacaagggcgacaccgctccacaggcagcaggcgttatccattctgacttcgaacgcggcttcatcaaggctgaaatcgtctccttcgaagatcttgacgctgctggttccatggcggaagccaaggcccagggcaaagtccgccaagaaggtaaggactacgtgatggtcgatggcgacgttgtggagttccggtttaacgtctagcgttattgacgctcctcgttatacgctggtctcgtgatcagatcgttcgccgaccgcgacaccgagttggtctggttgcgtgaaggtgcgaaacgcgtcgatccgcgaatacacaaagtggcgaatcggaagctgcatctgctggacgcggcgacgaccctcgatgctctgcgtgtgactccggggaatcgcctggaaacgctcgagggtgatcgagtcggtcagtacagcattcgagtcaacgaccagtggcggatctgcttccgttggaacgactcgggccccgaaaacgtcgagatcgtggattatcactgaggaggagacgatggctcagaagctctacccgccgattcaccctggtgagattctcatggaggacttcatcaagggcttcggcctcacacagaacaaggtcgccgtatcgatcggggtgcctccgcgacgcatcaacgagatcgtgcacggcaagcgatccatcacggccgatacggctctgcgtctcgggcggtacttcggtatcgacccgcagttctggctgagccttcagactcagtacgagttggagctcgatcgcgacgccggtgcagcgacttacgcacagatcacgccgctgaaggtcgcgtgagctcggtggccagaaaacatctgctctccctggcagactggaacagaggcgagcttgaggcattattcgagctcgcggagcagtatgaagctggcggtgggccacgattcgatggtgccgcggcgatgttcttcccgccgacgagtttgcgtacacggctctcattcgagcgtggggcaacggcaatgggactccagccgatcacgttcccgtcagacagcctggacaaggacgaagatctcgtcgacgtcgtcggctatctctcgcagtgggctgatgtcgttgtcgtccgacacccgcaattgacggcgcttcagcggttggcgtcagcggatgcagcgcccgtgatcaacgcgatgacgagtgagaaccatccgtgcgaagtcctctcggacttgtatgcgctgtctcgtcaccatgacatttcggccctgcggtacctgtttgtcggtggcgatggcaacatcgccagggcctggtgggaggcggcccaagcgttcggcctcgagatgcggcagagttgtcctgaagagctgcgtgtcgtcgggatgccgtgggaggagaacctgccgcatgcaattgcatcagcggatgtcgtgctgacggatgggccaggtagacatgcggagttactcgagccgtatcgtgtgaccgctgcgttgttggatcgcgcgccccgtggagtgcggctcgcgccctgcccgccgttcatccgcgggcgcgaagtgagcgccgatgcgatcgagcatccggcgttcgtcgggtactcgttcaagcgtcatctcatgccggttcagcaggcgattctggctcggtcgatcaatgcgtagcggttttcggtgtcggaactcggtggagtttcggtttaacgtctagtcgcgttccggttcaacctcttgcacaagcgtcggcccctgaaaggagccggcgctggtgttctcagttcgctactactcaaacgtcatcccgagaaccgtccggacgggaatgtttccgccatggtcgtctgccagtcgatgcataccgagctttcgggcgacgcgttccgaagcttcgttctcggggtggatgatggcgaccaactcgggtgagcctacaacgtcgcgtgcgtagtcgcggcatgcaatggcggcttcggtcgcgtaaccgaggccctgccttgcggtgacgacgtggtagccgacctcgagcttgggtgcgccattcacctcttgccacgtgaggccgcagtcgccaacgaactcgccgtggatcgtctcgacgatccataggccgtagccgtgctccgcgtagttctcttcattccaagtgatccacctggctgcctgctcgcgtgttttcgcggaggggtagaaacgcatcacttcaggatccccgagcatgtcggccatgagatcgatgtcagcaggccgcttgcggcggaagcggcggcgttgggtatttggcggagtcactggttcagcgtagttgcggggaggcctcggtccaaaagttggctgaggttagaggttggtatccgccggaactcggtggagttcaagttcaacgtgtgacgggcgcagaagagtggtcagtcgcgggggacgccagtcgctcgagtgatcactgggtcgaactggcgatcggtgaggatgttgcgcgaggcaatcagcggtttggcaccgaagccgatggcatagcgggtcttggggtgacgtgccgtcacggcctttccaatcgcatcggcgacaaccgacggtggtgagttgcggttgctgttcgcctcagatcgcaacgacttcgatactgcgtcagcctggcgcttgtatgcgctgtctttcgacactgcgtcgagattgtcggcagcgattcctccccactcggtggcgatgccgcccggttcgatgacaacaacgtcgatgccgaatggggcgacctccaggcggagggcgtccgagagggcctcgagggcgaacttggtgccgtgataccagccgccgagaggcgtgtagatcttcccgcccatcgatgtgatgttcacgatcgtcccccacttttgtttctgcatgtggggcaggacgagtcgggtgagggccatcgcgccgaatacattgacctcgaactggcgacggccttcatcgattgtcatcggtgacgtccatctcgagggggtggatcccgtctgaagcgagcttttgggggcgctctgtcctgcgggcagcaccgtagacggtgaagccgagtgatggctcttccggttttagagtgcactctaaaaccggaagagccactaaaacccctgtgtccactttccggggggtgttcctatataggttgtcaactccgtgggtgaggttgctgggggtgtgaaggggttctgcttcacgctgcggatgttgttttcgggcatgctgaagagccgattgggcttcctgcacaatcggcttcggggcttgtaggggctaggccgctgcggcctcctgggctgtggggatgtctctgtagagctctccgctgcgcatcatggcgaagaggacgttgaggcgtcggcgtgcgagcgcgacgactgcggcgttgtgtcttttgccttcgttgcgttttcgttcatagaattgccgggaacgctcgtggaatctgatcgatgcaaaagacgactgccatagggcgttcttcaatttcttgttgccggcccggttgggcgaattcgacatgatcgacgttcccgactgatttgtctgcggcgacaggcctgcataggacgccaggtgcgctgcatcgggaaagtcggacatatcgccgacggtcataaggatttgcgcggcgctacgtgggccgatgccgggcatggacaagagaatctcggtctgaggaatgtcctggatcagctcgagtacctggccttcaatctctttgcggtgctccagcttggctagtgcatctttggcggacattgctacgccaagttccgcgtattctgcgccggcgatggataccgtctggccgtggatcgcagcaagcatggcatcgataactggctcaggattacgtgccctgtgaccacgtgcgaaagctgccagccgtgctttgccgacgcgtcgaatcttggtggggccaccgtatttcgccagaaggtggagaatccacttgcggtgaatcatctgcccacgcaggacatgttcgaatgcggggtaggtgcccacgagcgcggattgcatctggttgatcaggcgtgtgtaggcgcgggcgaggtcttcgtcgataccgttgaggactttcagctggaggaagacttcctcaacgcggtcgacgctacgcagggcatccggaaggttgaggccggcatgggcgatgacataagcgtcccgtacatcggtcttggagttgccgacgtggatacgtgaaagttgtcgcatggcaagcccggggaggtagcgaacgtcggctcccattgcttgggcgactgcgacggttagcctgccgatgttgttgggctgatcgacgacgacaaggacctcggcgtcattggccaggaatttgtcgaagagcttgcgtagcgagccttcgtgttggttgatgcgtttggataggacttgtctgccctggggatcgaggacgcaggcgtggtggaagtatttgccgacgtccattccaatgacgaagtcataggccatgagtctgtgcctcctagcgatgagtagggagttggattatttacgcttcatcgctggggtggtcggacatacttgtgctggcatccacattactgtgagacctcgtgcctcctgggccgggtcaggttcctattagcagtttgagtatgtcactgtcttcggcggcatcaccccccggatcattttcagacagggacaggaataaaccataccgaagccagcgactagttccactgtcctttcggacggcgggaacggacataaacatagtccgccctctcgggtggacggactatgaatcttcggtgccctggggtggaactgctaacaacgtaatgggcaggcccaaaagaatactttaaaaggataagatttatatgacagcctgattcacattgtaaaagccctattctccgtgaaggatgacgattgctgtgaatacgaccagtcgttggctacttgccaattccagtgaccccttgttgtatcgagacagttcactgctggttgctttgttgcgtcagattgtctttgcgttcgcgtatttgattgctgtaattggctcatactcactggtatacggcgattcgttagtcgcaattgtgtggccatcagtgggaatcgctgtgtggtgggccgtgacctgcagaagctggaaaaacttcgccctgatttgtggatacgtgtttctagtcccagccatatacctgcacttttttgcggaaacctccctcaggggagtgattctggcaggaattgcgcacgctatcgcaggtcctggcgttgcactggttatggcattcatggaaaatgcgcaattgccagaactgttgcgtaaacggcatgcattcgcacccttctcccatattcgccttccaggcgatgtattccggctcctcgtcgcgggcattgtcatggtcgcaatatccaaattgattgtgattcttgcttatgcactggcagatttgccgtattcattcaccctttatctgacgatggcccttcgtgacttgactggcattattgtggttgccgggcccggaattgcactttcgacgccgctggtactaaatattcaccgatcagcatggcgcgagttcgcagttgttatcatagctacggtcggagtgctggcgctcattttcggatttgctgtggatcttccgacggtctacttggcaatgttgccattgtattggagtgcaacccgtcttccagtgcttttagccgttcttcatgcggtgtttacttcagcaatagtcgtaattctgtatttcctattaggtaccggatcttttgcgattacggatgaatccatactggtgcaggcaacgacaattcagctttttgttctgatgtgtatcttgttgtcgctagttgtgtcaacgacagtccagcagacatcagcactggttgaagagctagaggtggtagcgaagacccttcctgatgcgctttttatcgtaaacaaaaatggaacagcatttcctgttaacgcaggcgcgaaaaatttcgtcaagcaatcaccggatgggcattattccatgccgaaactacagaatatagacggtgaacccatggatgagaaagaaagtccgagcagtatggccttgcgtggacaaggtgtcgaaggagtattagccaagttaggtgaagtactgggagaagatccggacttggcgcgtcgaatcttcgaaattagtgcctcaccgatgtatctgcgtggagaaactgaaccgggtcatgcgctcgtgatttggcatgacagtactaatgagtattacacgatgcaacaattgacgcttgcatatgaagaatcgcggctgctatttgaaaaagcccctcaagggattgccatgctggacccttcgggagaaatcgtaatggcgaatcgatcctttggtgacttggtgggaacgactcctgttcgactcctaggacgaaatctagaggatttcggagtagaggagggaaccatggaatacgtgacccctgttctgtcggacccagaagccgttgtgcacttagatcgttcgctcgaaacattgagaggtaaacagaaaaacgttgctatgtcatttagctcgatgggcaatgttggaggcagaatcggaactttactcgttaatgttgtcgatgtaaccgagcgccaagaactcatcgagcttgtggagcatttggcggatcatgactccctgacaggattggtcaatcgcaggcggctggaatctgatatcgaagagcttatcctcaagaatgaacgcgattcgaccgatagtgcattgttgcttttggatctggattacttcaaggaagttaatgattccctcggccatgaggctggtgaccagttgcttattgagtttgctgagatcctcaaagacagcgtgagggattccgacattgtcggacgcatcggcggcgatgaattcgttattgttttgcctgacacagacagggatggcgctgaagcaatcggtataagaattattgagttggtcaatcagcacttcaaaggccgaggaaaagtgttatcgcgggtgtcagtaagtatcggcgggacgctcttttctgatgctcgtgcccaaggtgtgaatccattcattcttgctgatcagctgctttacgatgctaagcacgcaggtagaaatcgggttgcggtgcgcagagctgaaaacaccattgtccgctcagctaagcccgcattctcagttgaggaactttcggagatcctggagtcacattctattcgcctcgagctgcagccgatcctagaacttgaaacaggtcgggtgggtgcagccgaaggtctgctccgaatcaacttggatggcaccgatgttcctacggggcagtttgttcagtcggttgaacaggccgggctagccccgaagcttgatatcgcagtcatgagagaaggaattaatcatattgagaggctgagagctgtgtgtccgactttcagcctcgctttgaatctgtcgggctattctctgagctcggcgaaaatacgggaggaactaagagccgaatttagagctcgcgatctgccaaggggatcaattaggtttgagattactgagaccgctccgattgaagacattgacgcggcaaaagagtttgtgcagatgttgaaagattttggcttccacatcgtaatcgatgactttggcgcaggacatgagccttatcaatatctaaagaagttcgactttagcgtgctgaagattgcaggtgaattcatagaaggtatggtcaccaaccgcgtggaccgaagcatcgtcgaatctattgctcaacttgctaaggatgaggagatggaaactgtcgccgagtttgtttcaagcaaggagattttggaggcggtacgagagataggcgtaacgtacgcccagggtttccatattggtaaatctaagccgattgatgaatttatagctacttatctcgagacgaaccaaaccgctacctgggggtaggaagaatatgaaaaagaagagctttccaatcgcaagagtcatcggtatcggcgtccttggcatcgccgggatgggaatattgttgctatggcttgcagttaccctgtctgatccagcatcaccgggtgccaaagaaaccgaagtctttgataggtggaaagtgctctttgatgactatattccaccagtcagggtattggttgctgcgattatcgttgcattaattttcgtctttatcgctgccacagtggaacgaaccgtaaccaaccgctaccgaagctccgtagacggcgaaagagtgccattagcgccgaagattgtgatggcagaaacccgaggggtatttcatggaccgattaccattaacgtgctcgtgccagcacacaatgaggcggaaagaattactggaacaattcaggcattgaaatcacaacatgagcctccagaacgcatcgttgtagttgccgataattgcactgatgaaactacggaattagcccgtgctgagggagtggaggtcttggaaacagtcaataataagtttaagaaggccggaggactcaatcaggctttgagccggatgcttcccacattgggggagaatgacattgtgatgatcgttgacgctgatacagcacttgatcaaggtttcctcaaggaagcacggcgccgctttgagtctgatcgcgctctaatggccgtgggcggattgttctacggtgagtcaggctccggatggcttggccaatatcagcgcaacgaatacacccgttatagccgtgacatctatcgacgccgcggacgtgtgtttgttttgactggaacagcgtcggcttttcggccacgcggcctgcggacagtagcggaatcacgcgggacattgatccccggacgtaaaggcgatgtttatgacaccgcggcgttgaccgaagataatgagttgaccctggctttgaaatcactcggagggcttatggtgtcacccaatgagtgctcagtagtgacagaagtgatgccgacttggagagaattatggcatcaaaggcttcgatggcaacgcggtgcgctggaaaacctcggtgcttatggcatcacaccacaaacgacacggtattggttccagcagctgggaatcggttacggcgcattagccttggtcgcctatttcgcagtcattatcattacgtttctcgcccgcgatcaatggatctggtatccattctggatgctgctgggactgttgttcatgattgaacgcgtgctaacggtgtggagatccacatggtttgccaggtttgttgctgcgttattaatcccagagctcatctacgccagctatctcaacctggtatttctcaaaggcgttgtggatattctattggccaagcaagctcactggggtgagcatggtgacaagacaatgcaggtagccgatgcagctgccgaaattaacgatgaaggggaggaacgccgatgatcttttcagaagagattctccataccgactggttcgcagcacttgctgctttcgtcgcgattaacacaacaatctatgtggttcttgctattgccaagacgctgccgaagatttatgtcactgactacttaccgcggaattatgagcgtgctgagacacgcagcatttatccagacgttgaagaaccgaaaaggaagaagtctgagaagaaggattagggcggataacgaatgcgcacggcttcaaccattgtttaggcaactcccgacgataattcaggtacctcgttccttcaatttgaggtcgtcgttcgactaggtagcaagcagtagattgagtccattagagggttgagatggctacttcggcactgaaatttttgctgcttgggtttggcgcgattggtcgccaacttgttacgctcttcgacgagggagagtttggagtcgaggcgtttacccgtgctgtctccccacacattgcgcatgggactttgggaattgagctgtatgacgaccaactgcccaagctcatcgcagacagcggcagtgtggtcgaagtagcacacggcaaggatctcgttctgacgtcggtgggcgcgctagctgagcaggtcgtgcgacaagcgctacttgtaggttccgggaaagtgcacgtgacttcgggcgcaatcgggctcttccggttttagagtgcgttgattttgtgggtgagttgtccggagtggatgagacagtgcaggatgtagtggttgaggttgcgaaatcctagggcgattccgcggaggtgttcgagtcgtccgttgattgcttctacgggtccgttagagattccgacatcgaaatacgccaggatgtcaccgaggcgtttgtgtaggctgcggcctagttgtgcaagttctcgattcgcttgtcctttcagtagccgcatctggtcaacaatctcgcgcatcatggtctttgcgcggcgtttatcggccatgttgtatcagtcaataatgccttgatacgcctgccacatcagttgcagtgccgcgtagtctttatcaaagctaaacaactcatcaagacgctttgctttttcttactcaaccatttttgcgtggtcagcaaggttttccggttcttatacaacgggtcatcatgcaaaccccgccggtggtatttttcctgctgcaaacgttgtcggcatcgggtgagtttatcgccggcgaggagtaccacgtggaaaggatccatgactcggcgtgcggcgggcagaagttgtttgctggttgtggcatagccttggaatccatccatagttacaatgcgtacttggtgtcgaaatgctgggcttcggcgtgcaagccacgcccgcaacgcatcagcactgcggccttcgactacatcaagcaacctcgctggggacgtggcatcgcggtggaaggctggtcatattaacaatgacggtgacatagccatcaccatgttttaatcggttatgagatcatttgtgctcatcgacgccaataacgtgcacaatttctaggtgggtggggtcgtagtagatgagttcgtggcacatatctagggctagttggcaggtgagatcccagcctagaccgagggctttcgcggttgctgcgatactcatacggtcgatgtcgaggcgttacaatcgatgttgtcgaataaggcgatttcgagtttgaaaactgtgtgaccattgcgttcgtagaggatatttggatttctggcatcaagcattgcttggtcatgttcatcgacgaacatgttgtcgtagccgtgtttcccgccgtcgaaaaccgtgatttcttcgtcggtgtcagtcgccttcgcgatgacaatgatcggctcgtcatctgtgcggacaagaagctcgtaatgttcgaagatagtgccgttgtgctacagctcgaacttcgtgccgctgtttgaagaatgcaaggttagcgtgcgaccgaaatcttgggtggttaatgtggcgtgacctccaaggtgtgatggaattggctcgttccaagtcgaattctgtccagctgttttaggcatcctcaagttcagtttcgatcaggggttcatcttcgtgcgaccagatgtagaaagcatcatcgtcgggaagcagaattattaagtcgcccgttccgtcatttgcaattgcgatcgcattttcggggaaattgtcccattcacgtgcagattcggtctcgcggatgatgtcgttggcagttcggacaagcctttttcggtcgctgtcatcacgaactggatggagaatccagtcgttgttttcattgtcgatgacttcgccaccattgttttgaagtagtcgttcgcgcaaagtttcggggaggcgcctgccaagggtttcctcagctgccaggattttgtcttctgtcacggggaaagccatgccaccataatacgggccaaaagcgttaaaagatgtttgcttttcgacgccacgaccctcccatttctacaataagtagagtgtaagcagcctcaaggacaaggaagtgatcagaaggtggcgtcgccagagaatattctcttgtatcttcccgaaaaggaagaacagcaggtgcgggaggtgtttgctggtctggaggagcaagggtttcccgtccagaatcaaaaaccacacatcactattactttttctccctcgatgccagacgatgttgtgcagcgagcctcggagctgcttccacctgtgatgccagccagattcgcgcgcgttggaacagtggtatttggaaccaagcgaaaacaaaccgtggcgtggctgttggaaacatctgaagaactagaggaagttgcgaggaatattagcgcacttaatccgaacgggcgtgggcaacgttgggttcctcacttaactatggggttgcggcttccgagggagattgttcccgattacattcgagccttggatgaggtgacgtcgccgcatttcaaagagttcaccgcaacaacggctgcatattggcgacctaaaattcatcacctcaccgtttttaaggcttagaaaaatagcagtgttgggatgtgaatatccatttatgctgctgtagtcggctatgtggacgcatggtggcaacctctcagtttatcgatgacagcgaggctgcccaggcggtacgcgcagctattgttgcaggataccgaaacattgatactgccctagcgtatggaaacgagcgcggcgttggcgaaggcattcgcaccgctggagtgccccgcgaggagctctttatttccaccaagctagctgcagaaatcaaagattacgatggagcagtcgccgcgattgatgagtctttggcgaaaattggcttggattatgtcgatctgatgctcattcactccccacaaccatggagtgatttccgtggtggggactattcagagggaaaccgtgaagcgtggcgcgcgctggaagatgcctacaaagccggaaagattcgatccattggtgtctcgaacttcctggaggccgatctggagaatatcttagactccgcgacggttgctcctcacgttaatcagcttcttgtgcatgttggaaacaccccaagcgagttaatcagtttctgcgattccaagggcattctggtcgaagcatattcacccatcgcccacggagagatgctgaagaaccagcaggtcaaggcgattgctgacaagtacaacgtgagcattccgcagctatgcattcggtacacaattcaactgggaacggtgtctttgccaaagactgccaacccagatcatatgagctccaatgcgcagatcgactttgaaatttccgaggaagacatggcggcacttcaagaagtgaccgcccgcgattatggcgagcacagcggttttcctgtgtattccggcaagtagaaagatttttatcatgggacaaaaagtaaccgcaggtcgtgacatcctaggagagtttgcacctaagtccgctgaactcaacgatgatgtcctctttggccaggtgtggtcgagggaatcagagctttccccacgtgaccgaagcatcgtgatcgtgacaatgttgatggcaagtggcgtgctggatagtgcttttgaaagccacgttcagcgagccaaagacaacggtgtcactgctgaagaaatcgcagagatcatcacccacgtggccttttatgcaggttggccaaaggcttgggctgcgttccgcatcgcaaaggacatttacaccaagtaatagcgaggcagaaaacacatgaaggtgggcgtcgaaaagcatgcttctcgacgccaccttcagctgcagggcctaggcgctaggcagaaacgctggctagatctgtttggaatagtggggcagtggattccacaggaacgatattggaatcgaggatgccgtcaatatcatcggtatcgtcagcccgaagtgctgcaaaagttgcggtcaggctttccttgggcaggtccataagtggcagaaagctcgaaggttttgtttcgtgcttttgcatcattcaaactgctaaccaaaactcgcgcgatttgatcacgcgcaatcacgccatcggctgggccacccgactgattggtgtcgccttgaagcatgacgatctgacgctcgtcatcgttgttgtaatcaaaccaaccagggcgaacaatggtgtaaccgtgtccgctagctcgaacaagttgctcgccatgtcgcttccactcggcataagccacacctgggcgggtcgttccaacggcggtcatcagcacaatttttacatcttttcccttgactgccttcaacgtgttggcaacgccggtgtaatcaacatcccgcacatcgcttttacgagtggaggtgccgtgagtgaaaatgattccctcgacgccttttacagctttctcaatcgaggaaggatcaagcaggtctcctacgataatctctgcctcagctggaagcacccgtgcacgggacttgctacggacaaatgccttaacttggtatccctggttaagtgcttccgagacaacatgtcggcctatgcttcctgttgctcctatgactaaaactgtctcactcataatgttctcctaggttctttgggtttgggatgttccctcaatccatctaatccgtgtttcaattgccctgggagtggctgtttaccctggtattagcaaaacttcttaaagagcctttttgtgcctttatccgagtatctttaaaagcatgagtattaagtgggcgcgctttgtaccggggataaccgcgatgcggggctatcaacgatcctggttgaagggtgatgtcatcgcgggtataaccgtggccgcgtacttggttccacaagtcatggcttatgccgtcattgcggggctgccagctgtcgttggtctgtggggagttctggctcccatggcgctgtactttttcttgggcacgtctcgaaatctctcggttggtcctgaatcaaccaccgctctgatgacggctgcaggtgtgggagctttagtcggggcagctggcgggcctgaacgatacgcagaagtagcggcactattggctattgcagtgggcattgtatgcgctgttggttttattggccgattgggatttcttaccaggctgttgtctcgaccggtgctcgttggatatttgatcggtattgcagtcttgatgatcgtcagtcagctgtccaaagtcacccaggtgaatgtggagagcggtcagacgtggcaggaaataatatcgtttatcaaagtagctggccaggcacatattcctacagtgattttggcagtcgtggtgttgagcttgctgtatctggcaaattggttgacgcctaaatttcccagcacactcatggttcttctgctttcggcagccgcggtggggttttttcatctggataggtttggtcttgaggtcattggtgaggtgccccgtggcctgcctcaaccaagtattccctcgattggcgatctagagatctggtcgttgttgccctatgccgtgggtattgccatcgttggtttttcagacaatgtgttgactgctcgtgcattcgcgtcgggaaaagatgaggtgattgattccaaccaggagctgctcgcactgggaaccgcaaacctggcgaatgggttcttccagggatttcctgtgtcatcgagtggctcccgaactgttcttggagacacggcaggtgctcgcactcaggtgcattcacttgtcgtggtggcgctggtgatcatggtgctgttgtttgctggtcctgtgctcgagtctttcccagatgcggcacttggcgccttagttatttatgcagcaacgcagttgattgatatcgcagagatcaaaaggatcgcacgtttccgcaagagcgagttggtcatcacagcggctactgctgcatccgttgtggcttctggcgtgctcgcggggatcggcgttgcggttacgttgtccatcttggatctcatcagacgtattacccgaccttatgccgatgtcctaggatatacgccgggcatggctggaatgcacagcttggaggattatcctgagtcgacagcagtcgaagggctcgtggtttttagatacgattccccactgtttttcgccaacgctgatgatttttccaaacgtgccatcgaagccgttgatgaagcaactcaacccgtgcattggtttttactgaatgctgaagcgaatacggaagttgatctcacggccgtcgatgccatggaagcacttcgcaaaaccctggaggaacggggtatccgatttgcgatggcccgggtgaagcaagatctacgccgaagcctcgagcctgcaggtttcattgaatccgtgggggaggagtacattttcgccacactccccactgcagtcaaggggtattccgtggagtttcgcgatcgttttggaaactatccagaaggcgttccgaaagaaattttggaactttaagctgcctggttggcggacttagtcatgaatcaacttgttggatttcatctctttaatgaggattacaacgtcaatgatcatctgcgaaatacggccttcagccatgtttagtttcccttcgaaatgaatcaatagattttcacagtattctgaactctaggttcaaatcactccatcccagccaccggaatctaaaatctcaagcatcttgaccttcgagagattcaagttctgcagtagctaaccagcgggagaactcttcaatcagataacagagtctggccagctctgcacacgttttattgattgtgcagcaataaatcgaggttcaaaacataggaccgcattagcgattagcgcgcgctgagctttagtttacagctaacatgaggtgcataaacaaaacggtagatcagcaaatcgcactgtttgggcaatcgggaagcggaaaaactgcattattgtgctctttttatggtaccgcacgggaatcctcgcaagaggacgtgaaattattcgagatctctgccgaagatgatcgacacacagaattgatgagactgtatctgggaatgagagatgattcgcttttcccacctgcgaatcgatttgagtcaaaaaatacagtcttttctctgaaacaaaaaggtgttccgattaaagaagcacggaaggcagatcaggtccgggtgacctggaatgattatcctggcgagtggttcgagggaggggccacgacggaatcagaaaaacaggacaagatcaatacttttagaaacctgttgggttcagacgtagcactctttttggttgatgggcaaaggcttcatgactatgccgatgatgaggagcgctatcttacgtacctttttgatagcttcactgaatccttgagccaaatcaaagaggcgattttggaggatggtacaccgctccaacagttccctcgcatctgggtgattgctttgtctaaagctgatttatagccggatctcacggttacagaattcgaaaatctgctaattaaaaaggcaggcaatgaaatcaatgaactgcgttcaaagctgctcgaatttatcgataatgatgaagccttctcatttggaaaagacttcctacttttatcatcagcgaaattcactcccgggacatactgatctcagccagcgcaagggcgtcgatgtgctcctacctctggcttgtgttctgccgatccagcaccagctctggtggcaggagctgagagttttgccaattaacttggcgaacagacttgttggaaatgaatttgtcaagaatggcatgaagatcatcttcaaaatggctagtaacaagttcatcgacaacaaaaaggggctggctatgctagtttttgccgaacttgtgatggaaatgcttgatcagcctgaagaacaacttcataatgtgcgtggagtggctattgagaagcgggagttcctcaaagctctcaccgctgatttcaccagcagacttaaacaagctcaaaccgataagattcttgtttgggatttcgcatgactattatgtgggcgacccgtggaaaaaattggggtttccgattcctcgccgacggtgccgaaagtgatccacttcctacctatacgaaagcttttgaaaatcgggagtgggaaagagaatttattcggacgagtccagaattcacagctgctcgcattgacgacccgctcgatcgcaccgacaacgtcggtcggaccataccgcatgattttgttcttcgtgggcagtttgcggagggtatcaacacactagaggatgtccgcgagatcatttggccactagtcgcgcaacagtatgaagacatatgggatcaaccaattaactctgattaatcctgacgccactagagataaacattcggatttttagacactttcaacacagttgctgttgtcatcaacctcaccacggaatctattttgttcccgtgttgctcgttttttgattcgcagatacctgtgagcaaagcgtgaaaatccagagtcgtagtcctacatagtaacggttaaagtctcgttagcatggcctttcctccttcggaacggtaactccggagtagatcagccagataaacagaaccacttcgcccacgaatgtgaactcagaaatgccaggatttggggagcctaggagcactgccactgcatcgactaaatatcctatgcctgtgatgaccgctagggtgccgatgatcgtaggaaccttaagggataggcacagcagcacgcctatgaggatgagatggactccaaatattgccaggtttaaccgttgattgggacactttgttagacccctatgattctgagcagagtgttgttgtgtggactggtaagccaggcagcaatacccacaaatcactcatggttcttgctggcctggctaaggcgaaaacgtccaatgctcagtagcggtgtcgtaaatactcgcccacgactgcggcgccgagtccgtccagatcgggagccaccacggtgccgccaacacggtcggctagttggttgagaaagtgctctaatccttgatcatgtcccagtcggaagagtgtggtgtgggttcctcgcttggttactttatctagttgggtgacggtcttgaacatggtttctgggtcagtgggccagttgaaccaggcgtgtccatcggcttcgaggtgagctgtgggttcgccatctgtgacaatgagcaggcttgctttcatggagggatggcgagcaaagaaccgttctgccagcagtaatgcgtggtggagattagttccttgttcgtgaaccggtggcagtgcagtcagttcctcgatgtccatgttttgggcatgtcgaccaaaagtgattagtgctagttcatctcctctaaaccgggtggataccaggtggtggagggcaagcgctgtttgcttcatgggcacccagcggccttcggcagccatggaataactggtgtctactagcagtgccacggcgttgagggtgcgggcttcagtttcaatgacttccacatcatctaagttgatgcgcagcggaccttccgtatctgttccggctgttcgctgcagagcattggtgatggtgcgggtgacatcccatggttgggtgtctccgaaaacataaggtcgggatgctcccgtcgcttcaccgtttgctcctgccaaccgggagtctcgcgagcctgggcgggacgataattgttcgctggcggcgtcgagaagcgctttccctagacggcgcatggcctgggggctgagcttcaatgagccatcggggttgcggcgaagaaggccgctgtcgcggagcgcgcgctccagtttggccaaagtttcggcagagacagcggcgtcatcgccgagttggcggcgaatcgcatcaatgtcgaggtcggtgtgggagttgctcagttgttcagcaaggttgtcgagttcggcgaggtcctgcatggcgccggtgccatcaccaagtcccatgccttcgtcgccggagaattgttcggagccatcccagttgaggtcggggcgcagaccttggaggtttccagccaggtcaccgagcaattcctgcagctctggggatccgaaagcttgggcagatagtttcatgagttcgcggcgttgttcctctgatatggagttgaacatgcgactggctgcggcggaacgggctgcgagggcatcgatgagctcattgatgtcgcgcggctgctcggggaagtgctcgccgtgtttggccataaaattggcgaaatcggtgggagtgtccgttccctcgcggtgtttggagagcaggtcgttgagatcgcgcagcatttcggcgatggctgctttgtcctcgtcggaggcaccttccatggcttgtttcatgccggagaattgctgatctaacatttcacggccaagcaggtcacggatttgttcaaacttttggcgtgcttcttgggattgccaatcgtaggaatttagctcggaaacggcagcggcggtggattcagggaggttgctgatctgcatttcgcggaatgctcgatcggtgtcatccatatcgatatcgcgggccagttgagcgcgttccagcttgaggccttcatcgagaagcttgcgaacctcagcgagtgtgccaccgaggttgtttcggctaagtaattctcggcggcgttcggctgcacgccaggctagatcatcgaggccttcctgtcctcgggcgcctctgcgcaggtattcacgtagtgcctgctcaggggaataaccagccatgacatcatcagcaatatcgcgcagggcatcgctgagatccactggaggtgccagcggatctgggcctccggtgtagcgtccgtaacggctgcggcggggtcgtgaatgtgaagtggccatggctgtggtgctccttaaaaccagttaaccgtaaatggtttcaccttcgccagaatccttggcaatttttcgggaaaggtaaagaccttccaaagcaagctcaatggccatcgcgcgagtacttggtgtggtggcaccaaaagcttgagcgatgtcgtcatatagcgtgctttcgccgagttcggggagcgaagccaaaaattctgacgcggtgatgttcgtgccagtggaaacggtgatgctgccgtctaatgctgcgatgagcggggtgagatccagcgagcgcagagtggaacgcagcgcttctgcggttgcggtgcgcaggagataatcaaggatttcccattcgcgtccttcttcgccggattcaaattcaatcttgccgccgaggacttccacggctgcttccaaatcaaccaggcgggcaacggcctcatcttcgccgaacactgctgcgcgtcgaagagctgctgcggccacagtttctgcacctgcaatggagaaacgagcagacacaccagaacgctgattcaccgatgaggattcacgaagcgctcgggtgtagcgggcaagaatttcaaccaagatatcagggacttgcgcaacaagctctgcttcctggcggataattgccacttcatcgtccaactcaagtgggtagtgggtgcggatttctgcaccgaagcggtctttgagcggagtgataattcggccacggttggtgtaatcctcagggttggctgaggcaacaaccagcacatccaagtccaaacgaatgttgtagccacgaatctgcacatcacgttcctccatgacgttgagcatggcaacctggatgcgttcagcgaggtcaggaagctcgttgatcgccacgatgccacggttggcgcgaggaatcagaccgtagtgaatggtttctagatcaccgaggctgcggccttcagcaacacgcattgggtcaacatcaccgataagatcagccacggaagtatctggggtggcaagtttctcggtatagcgcgcatcgcggtgtacccattcaatgggctgatcatcggagatctctacgtttggcgcaagagggtgttctggaacgtcgcgcccgggaatgatcggggaccactcgtcgagaagcgttattaacgtgcggagcaggcgggttttaccctggccgcgttcgccgagcagcacgatgtcgtggccggcgatgagcgcgcgttcaagctgcgggatgaccgtgtagttcaggccgtgcaggcctggccacggatcttcgccgctgcgaagtttggctaggaggttgtcgcggatttctacgcgcaaaggtcggtagatgtggccggcggccttcagctcaccgacagtttgtacatttggtggaagactcacaccccacaccctagacctttttttaagtgggcggtcaggaatttttcgcacaggtatgctgcatgtcatgaagccgggttcacacgcagctgccgaaaagactcaatccactgtggttttactcattcggcatgggcaaaccccaacaactggtcaggttctgcctggtcagacgccgggtttacacctgtctgataagggtgaagagcaggcgcgggaggtggcacagcgtctggcggaggtgccgattaccgctgtgtattcatcgccgatggagcgtgcgcaggaaacagcagcaccgacggtcagcgctcatggcctcgagttgacggtggaacctgggcttattgaatgcgatttcggcgagtggacgggccggaaactaactgagctcaatgccctagaggagtggaaagcggtgcagaagacaccgtctaccttcaggtttccaggtggtgagagtttcgtggaaatgcaggatcggatggtggaggctatcggcaacattgcgcagcagcatccgggagaaatcgttgctgcgtttagtcatgccgacacgatcaaggctgcggtggctcattttgtaggcactccactggattcttttcagcgcattttcatcgacacggcgtcaatttccgcagtggaatttaccgggaaatcttcaggcgtctcctcccatatgctgctgacaaattccagaacaggatcgttgggataccttcgagacaaacttccgaaagctccgcaaccatgatcacctcaccatttgagcgcgagctgaagctgctcaacgagggggaactgggtattgtccagcagttggtggaatcaagcaacatcggattcatcgtcgatcttgaattagatggcgattatgggtgggcggtctacaaaccggaattgggggagcaacccctgtgggatttccctcctggcctgtacaaacgtgaacgtgcagcctttgtgatcagtgagtttttgggttggaacatcgtgcctccaacggtgatcatgcacgatgccccggctggtgtgggctcggtgcagtggtttattgaaaacaatggcgaacactattttccactgtttgacacccgcgctgacctgcatccgcagtttgtccgcatggctgtgtttgatctgttgtgcaacaacactgaccggaaagcgggccatgtgttgttagacggcgatcatatttggggcatcgatcacgggttgtgtttttccgtcgaaccgaagctgcgcacggtgatttgggatttcgcaggctgcaccattccagatgacttggtgacagatgttgagcagcttttggaggacgtcccggaagaacttcatcagcttcttcatcccgcagaaattgatgcgctgcagcgccgtgcctcaagaatcagcaggttaccgttccttccgcaggcgaaatcgcatcgtcaattcccttggccacttgtttgagtaggctggcgggcaggtgcttgaaatactctgattagttccaagcaaattagcacaacttcacactttatttaggagcatgttatgtctgacctgaagtcacttgccacgaaatttgctagcgatcatgaatccggaaagctgctggtcctgcctaccgtctgggatacctggagcgcggggctcgtagaagaagcaggatttagtggcctgaccattggtagccacccagtcgcggatgcgacaggaagctccgatggtgaaaacatgaattttgcagattatatggcggtggtcaagaagatcacctcggcggtatccatccccgtaagcgttgatgtggaatccggttatggtctctcgcctgcggatttgatcgcacagattttggaagctggcgcagtgggcatcaatgtggaagatgttgtgcacagcgagggtaagcgtgttcgtgaggcgcaggagcacgctgattacatcgctgcggcacgtcaagctgccgatgtggcaggtgtagatgtggtgatcaacggtcgcacggatgccgtcaaacttggtgcagacgtttttgaagatccgatggtggaggccatcaagcgcatcaagctcatggaacaggcaggcgcgcgttcggtgtaccccgtgggtctgagcaccgccgagcaggttgagcgcctggtggacgctgtgtcagtgccggtcaacatcaccgcgcacccggttgatgggcacggcgcaggcgatctggccaccctcgcaggccttggcgtgcgccgcgtgaccttcggtccgctctggcaaaaatggctggctgccacctcggcgcagcagcttaagggctgggcttaaattgcttgtcgacgcctagtgccacaatggagacatgaccgaaacacttgtggtgaatggccttgcaggcggctatgggcaccgcacattatttaacgatgtgaatctcaccgtagctgccggcgatgtcgtgggcgttgtcggcgtcaatggcgctggtaaatccacatttctaaaaattctggcgggcgtggaaaagccactggctggaactatcgcgctttcgccagccgatgcttttgtgggctacttgccacaggaacacacccgcacgtctggagagacgatcgcagtttacattgctcgtcgaaccggctgccaagctgcaacaactgccatggatgacaccgccgaagcgtttggtgcggatccagacaacgctgccttggccgatgcatacgccgaggcgctggatcggtggatggccagtggcgcagccgatttggatgaacgcatccccatcgtgctcgctgatttgggctttgagcttcccacctcgacgctgatggaaggactttcaggcgggcaggcagcccgggtcgggctggcggcgttactgttgtcacgttttgacattgtgcttctcgacgagcccaccaacgatttggatctcgacggtcttgagcaactggagaattttgttcaggggcttcgcgggggagtcgtactggtcagccatgatcgtgagtttctttccaggtgtgtgaccactgtgctggaactcgatctgcaccaaaattcccaccatgtttatggcggtggatatgattcctaccttgaggaacgcgcagtgctacgccagcacgcccgtgaccaatatgaggaatttgcggaaaagaagaaggaccttgtggcacgtgctcgaacgcagcgtgaatggtctagtcacggtgtccgcaatgctattaaacgtgcacctgacaacgacaaacttcggaagaaagccgctgcggaatccagtgaaaagcaggctcaaaaagtccgccagatggaaagccgcatcgctcggttagaagaagttgaagagccacgtaaagaatggaaactgcagttcagcgtcggtaaggcgtcgcggtcaagttctgttgtttccacgttgaatgatgcaagcttcacccaaggcgatttcaccttgggaccagtatccatccaagtaaatgctggcgatcgcattggcatcacaggacccaacggtgctggtaaatccacattgctgcgcggactattgggaaaccaagaacccaccagcggtactgccacgatgggcacgagcgtggcgatcggagaaatcgatcaggcacgagcgttacttgatccacagttgccactgatttctgcgtttgaaaagcatgttccagacttaccgatcagtgaggtgcgcacactgctcgcgaaatttgggctgaatgataatcatgtggaacgggacgtcgaaaagctatctcctggcgagcgcacgcgcgccggacttgcgctgctacaggtgcggggcgtcaacgtgcttgttcttgatgagcccaccaaccaccttgacctggaggccatcgagcaattggagcaagcgttggcctcgtatgatggtgtgttgctgctggtcacgcacgatcgtcgcatgttggacgctgtgcagaccaatcgtcgttggcatgtcgaggctggcgaagttagggagctataaccgtttccgtattgatgccatggtgaattgatcgcttcacagaacacaggcgatcaattttcttcgcggcgctggcaataagtttgtcctgcgcctgctgatcgaggcctgccatatcaacttgcaacgtgtacagcagatcagtgatcagccctgtggtctccgtggattcgacagtcgcgctcgcagtgaaatcctggcccaactggtgcgcgagctgagcctctgccgacaaagaagcgcagccaacaacagcggcctgcaataattcacccggggaaaacgtcccaggaactcccggcgcgctgactttaagttcggctccgaaatcattaaccacagtgtaagtgtttgggctggtgcgggttgctttaatggaggtcatgctcgcaggctaacagaattggtggttttagtgctgttaccagggacatcggctagaatctgctgaatatgtctgatcaattagctccctgccctgagtgcagcagtgaatatacctacgaaaacggcggcgttctggtctgcccaatgtgtgcccacgaatgggtcgaaggtgaagtagcggaagaaaccgcgactgtcatcaaagactctgtgggaaatatcctcaatgatggcgattccgtatcgattgtgaagagcctcaaagtcaagggtggcggtgccatcaagattggcaccaaagtcagcggaattcgtcttcttgaagagccagttgacggccacgacatcgacgctaaggtccctggatttggtcaaatgcgactcaagtccagtgttgtaaagaaggcctaaacccttttaaggagctttagggcaacttgcgccagcggcggcgatggttaaagctgaaagggctaaaatcgctgcaagagtcgttggtacagcagtcatcacaatcccctttgcttaaaatttattaaggcctcttgtattggggcctttaatgctagatcttttatatcattaggctgtgaagtggggaagtgatccacagaaataaattctgtggatatggttttagaggtgcgtttatgggcacttaggggcggggccacttcatatcgaggtattcttccaagctttcattgtgcttccgcaatagcttggcatgcgttttaatgtcttcctcatcccaatcatgaagaatgcgggtgagatcctgctggcgggcaagaagctcctgctgcagtttttctttacccaactcagttggacgatgaagtttagcggggcatgcttgatcatcgacgacttcaattaagccattggcaatggctgctttgagttggcggtgcacggtagaaacgttaagtccaaagctttcagctagctcattaactgtcataggtccttgagcgtcaaggcgggtgagcaagatgagggcgctgcgatccatgatggcttcgcgcttgttggtcggtgtgttttggacaccataccgggtgagcaggatgatctcatacgcgagttgatcgagggtttcagcttggtcgaactcttctggatctgtagacactatggtaattcgctccctttaaaaacgtctggactcatagagtattttatatcctagcaagggtgttgcatgatgcaataaacgtggtagtttgtgttcataacaaaattgcatgatgcaataatttcgatttaaaggagaacagtgtccgtagctgaagaagggaaactttttacaccaacgtttgtcatgggatggtttgccaaccttttccagttcctggtgttctacttcctcatcaccaccatggctttgtacgccatcaaggaatttcaagcctctgaagtagaagctggcttcgcatccagctcaattgttatcggcgcagtcttttccaggtttttctccggctatattattgaccgttttggtcgacgcaagattgtgctcatctcagtcctagtcactaccattgcgtgtgccttgtaccttcccatcgaatcattgccattgctatacgcaaacaggttcctccacggtgttggatacgcttttgctgccaccgcgatcatggcaatggtccaggagctcattccagcgtcacgacgttccgaaggtactggttacctggcattgggcactaccgtttctgcagcacttggaccagccctagcactttttgtcctaggaacatttgattacgacatgctgtttatcgtggtcttggcaacctcggtcatctctttgatcgccgtcgtgttcatgtactttaagaccagcgaccctgagccttctggggaaccagccaagttcagcttcaaatctattatgaacccaaagatcatccccatcggcatctttatcttgcttatttgctttgcttactctggcgtcattgcctacatcaacgcatttgctgaagaacgcgatctgattacgggtgctggattgttcttcattgcctacgcagtatcaatgtttgtgatgcgcagcttccttggcaaactgcaggaccgtcgcggagacaacgtcgttatttactttggattgttcttcttcgttatttccttgacgattttgtcctttgccacttccaactggcacgttgtgttgtccggagtcattgcaggtctgggatacggcactttgatgccagcagtgcagtccatcgctgttggtgtagtagacaaaaccgaattcggtacggccttctccactttgttcctgtttgtggacttaggttttggctttggacctattatcctgggagcagtttctgcggcaattggtttcggacctatgtatgcagcactggcaggtgtgggtgtgattgccggaatcttctacctgttcacacacgctcgcaccgatcgagctaagaatggctttgttaaacacccagagcctgtcgctttagttagctagttctttcagctttccctcccgatcagcgtaaaccggcccttccggttttggggtacatcacagaacctgggctagcggtgtagacccgaaaataaacgagccttttgtcagggttaaggtttaggtatctaagctaaccaaacaccaacaaaaggctctacccatgaagtctaccggcaacatcatcgctgacaccatctgccgcactgcggaactaggactcaccatcaccggcgcttccgatgcaggtgattacaccctgatcgaagcagacgcactcgactacacctccacctgcccagaatgctcccaacctggggtgtttcgtcatcacacccaccggatgctcattgatttacccatcgtcgggtttcccaccaaactgtttatccgtctacctcgctaccgctgcaccaaccccacatgtaagcaaaagtatttccaagcagaactaagctgcgctgaccacggtaaaaaggtcacccaccgggtcacccgctggattttacaacgccttgctattgaccggatgagtgttcacgcaaccgcgaaagcacttgggctagggtgggatttaacctgccaactagccctcgatatgtgccgtgagctggtctataacgatcctcaccatcttgatggagtgtatgtcattggggtggatgagcataagtggtcacataatagggctaagcatggtgatgggtttgtcaccgtgattgtcgatatgaccgggcatcggtatgactcacggtgtcctgcccggttattagatgtcgtcccaggtcgtagtgctgatgctttacggtcctggcttggctcccgcggtgaacagttccgcaatcagatacggatcgtgtccatggatggattccaaggctacgccacagcaagtaaagaactcattccttctgctcgtcgcgtgatggatccattccatgttgtgcggcttgctggtgacaagctcaccgcctgccggcaacgcctccagcgggagaaataccagcgtcgtggtttaagccaggatccgttgtataaaaaccggaagaccttgttgaccacgcacaagtggttgagtcctcgtcagcaagaaagcttggagcagttgtgggcgtatgacaaagactacggggcgttaaagcttgcgtggcttgcgtatcaggcgattattgattgttatcagatgggtaataagcgtgaagcgaagaagaaaatgcggaccattattgatcagcttcgggtgttgaaggggccgaataaggaactcgcgcagttgggtcgtagtttgtttaaacgacttggtgatgtgttggcgtatttcgatgttggtgtctccaacggtccggtcgaagcgatcaacggacggttggagcatttgcgtgggattgctctaggtttccgtaatttgaaccactacattctgcggtgccttatccattcagggcagttggtccataagatcaatgcactctaaaacaggaagagcccgtaaacctctgactagcgtcaccctctgattaaggcgaccgcggatttaagagcagaggctgccacgagcgcatcttcacggctgtgtgttgtactaaaagtacagcgcacagccgttcgtgcttgatcctcctcaagccccaacgccagcaacacatgggatacctctccggaaccacaggcagaaccaggggagcacacaatgccttggcgttccaattccagaagaacagtttcagatcctatgctgtcgaagagaaaagatgcgtgtccatcaatgcgcatcctaggatgtccagtcaggtgtgctcccgggatagtgagaacttcctcgatgaattcgccaagatctggataggattccgccctggccaattccaaggcagtggcaaaggcgatagcccccgcaacgttttccgtgccactacgccgccctttttcctggccgccgccatggattaccggctccaggggaagctttgaccataacactccaatccctttaggcgcaccgaatttatgacccgacaaacttaacgcgtcaactcccaagtcaaaggttaaatgtgcagcttgcactgcatcggtgtgaaaaggcgtactgcttaccgccgccaactcagctatcggctgaatggttcccacctcattgttggcataaccaatgctgatcaatgtggtgtccggcctgactgctttgcggagaccctccggggagatcagcccagtgtgatcgggggataggtaggtgatctcgaaatcatgaaacctttcaagataagcagcagtttctaggacactgtcatgctcgatcggggtggtgatgaggtgccggccacgaggattagctaagcacgctcctttgatagcgaggttgttggcttctgatccacccgacgtaaacgtcacctgtgtggggcgtcctccgataatgcgggccacccgagttcgagcatcctccagccccgcagaggcgagtcttcccacctcatggggacttgacggattgccaaacgctccggtgagataaggccacatggcctcaagtgcttcattgcgcacactggtggtggctgcattatcaaggtagagcattagaaaatatcgagtcctaggtcaagtgcatgcacagaatgggtaagcgctccaacggaaatgacgtcgacaccggttgatgcaatctttcccgcggtgttgaggttgactccgccagatgcttccaccagtgcacgtccaccaatgagatcaacgccttcgatgagctgatcaatggtgaaattatccaacatgatggtgtccacaccagcagcaagaactggttcgatctgctctatatgatcaacttcgacttccacatgggtggtgtgggggagtttagctttcatattcgacagcgcttcagtgatgctgagcccctgggatgcgatggctgcgagatggttatctttcaccatgacagcatcggacaaggtggctcggtgattaaatccgccaccgtcacggacagcttggcgttcaatgatgcgcaggccgggtgtggttttccgggtatcaacaatgcgggctttggtgcctttaacctctgcaacatagcacgatgtcaatgtagcgatgccggacgtcctctgaatgaagttgagagcaatgcgctctgaacggaggatgcttctagcactgccggtaattgttcctaggatgtccccggtttcaaagctgtcaccatcagccaccttaagggatgcgtttatcctaggatcgacgagccggaaggaggcgtcgaaaagcgcctgcccgctgaacacacctggctcccgggcaacaaccttggcgctcagctgcgccgatcctgggataaaagtgtcggaggtaatgtcgccccatggcgcatcctcggataacgctgcgccaacgatgcggtcaatatgggtagtcataaattacgcatccttcgaggagctaggagtaacaggagctgctggaacaacagatagcatcctttccaaagcgactcgcgccggtgccgccacggattcagagacagaaatctggttaatcacgtttccagccaccaactcctcaagtgcccaggccaggtaaccagggtgaatgcgatacatggtggagcatgggcagatgacagggtcgaggcagaagatggtgtgctgcgggtactgggctgccaggcgctgaaccaagttgatttcggtgccgatcgcaaaggtagatcctgccggtgctgcttgaatggctttcacaatgaagtcagtggatccggatgagtcggcggcgtcaacaactggcatgggggattcagggtgcacgatgacgtgaacgtcggggtactcggcgcgggctttgttgatctgctcgacagtaaagcgcttgtgtacagagcagaaaccatgccagagcagtacctttgcgttttctagctcggaaacggtgttgccacccagtggtttgttgggattccacaggggcatttgatcgatcccaatgcccatggctttcgcggtgtttcgacccaagtgctgatcggggaagaacaggactcgttggccgcgttcaaacgcccactccaatacggaacgtgcatttgaggaggtgcatacaattccgccgtgctcacccacgaaacctttgagcgctgcagaggaattcatgtaggtcacagggatcagggtgtcatcgccataaattgaggtgagttgctcccagcagtcttcgacggaatcaaggtcagccatgtctgccatggagcaacctgcggcaaggttggggaggatcactgattgttcatccgtggataacagatcagcggtttcagccatgaagtgcacaccgcagaacacaatcgcttccgcctcgggtcgggttttggcagcgcgggcaagttggaaagagtcaccaacaaaatctgcgtgttggataacttcatcgcgctggtagaagtgtcctaggataaccactttgtcacccagggtgtctttcgcttcccggatcctacgatgcagttcgtcatcacttgcgcgctggtactcctcggggagaacctgctggcgcggagcatgcgcagggatcggatcgttttgtgacgcgccggggccgtagacatccggcattccgggctggtcgaggaaccagggtccgtctttgagttcactgttgcagctattggcatttttcaatgcaaggttgacagatggggtgattgaggtggtcatgattggggtcttttcttctaaacggtgggctggaatgagcgtcagaatttatctttggaatctgaacagtttgggtgggcggtgcggtgttcccgcaagcacttcgccggtgtcgatcagatcgggcgaggtggccacggatcttcggaagttggcggcatcgagtttgtgtccaaggactgcctcatgcacggatcgaagctgggcgatggtgaaggtttctccgaggaaggagtgggcgatttcggagtattccaccttggtgcgaagtcgttctagtgcatatttgacgatgttattgtggtcaaatgccagctcagggagatgatcggcgggaaaccactggacgttttctcctgggatggctttcaacgcttcatcggctcggacaagtgcccaatacaccacagagatcacgcgtccggttggggagcggtcgacttttccgaaagtgtagagctgttctagatagctggggtgcaggccggtggtttctgcgagtgtgcgggcagcagcatcttcaagttcttcatgtggtggcagccaaccgccgggcagtgcccatttatttaaatgtggttcgcgggtgcgcggaacgaagggggcccacaggctggggagatcctgggggccggggcgcagcgcgaagatgatcgtggatacggccatctggatttcaggtgaagcgggcaagaaaccaccttagggtcaatctgactttaactgttgagctatcttacagtcactttgactctaagggaagtgtttcgcttcaacccgtacaggtctaatatgtcgggagtcttgttttaagctcttatataacctgtataggaaagcgaaaacctcatgcttgcagtgctattcggggtggtggccggtgccatcatgcctttccaaacttcggtgaataatagattgcgtcagtccgtgggagcaccactgctggcgtcttttatttcctttttggtaggaactttttcactcctggttgcaacgtggatcaccagtgggcacccgtatcctgctctaggaaatacaactggccaaccgtggtggattttcaccggtggcatgttgggtgttgtgctgctgacgggaaacattttgctgtttccccgagtcggcagcgtgcagaccgttattttgcccatctccggacagatcatcatgggcctaattatcgatacaactggcctggcacattcgcctcaagcaccgttaaccctgttcagagtattgggtgctgctgcggtacttgttggatcgctggccgcagtgggagtgttctctaagaaaaacatcggacagacccaatcccaaggtgcctccatttggttgtggcgcctcttcggagtggtgatgggcatgtgccaagcaacccaggttgcagtcaatggttacttgggaactgtcctaggatcccccattgagtcagcactggtgtctttcgctgttggcaccaccgcgctgtttattctgctgttggtcacccgaaccaagtggcgtggaatcaacggcgctgggaagaaaaacccatggtggatgtggatcggtggcgtcatcggcgcgactgttattttcagtactgcttacctgggaccgatcattggcactggtgttaccgtggtggttatgttgctgggcatgatgttggccagcctgatgatcgacgcttttggaatccttggcagcccgcgccgccacattcacatcgcgcagcttctcgggctcgtggtgatcatcctcggcgtaacaatgatcagaatctaaaccaagaatctaaaccaagaatctaaatttccaacgactctccctcttcaagcggcgagtattccgagccataggtttcaccaagatgcgttaagaacttcttgttgatcgccaaaccgcgatcattaacaatgccatcgtgaatgccgatgaaacgctttggtggaaatttcttcaaatagccttccacatccagcattttcacccaggggccgttgacaggaaccagggcgagttcgacatctttaatgggttggaaggtatcgccggggtggagcactcggccgttgattaagtatccaacgttttccgcgatcggcatggaatgggtgagcatcgcatgttcagaaccaagaacctcaacggatagggacccaacggtaaagtttcggccgtgttccacgatgtggcattctactggaattgaatgtgctactgatcgaggcgcgtaaatcgtcatgccgggcttgagcaactcgggatcaacgtgatcggcatgattgtgggtgaccaggatggtcgcgccacataaatctggggcgccaaaagtaccgggatcaataatgattcgatcgtttccctgtgagatctcaacgcatgcatggatgtggcgggtaattttcatatcacccatcttgccacccgcaagcaaccaagttaaggccttttatacttcggcaaggtggaaattaccagttcataggactcttccacgagaccttcgatgaagtctttcgtgatccgttcaccatcgctaatgctcagccagtgcactttgttcatgtgatatccagcctggatggtggggaagccactgcgtagtgaagcgccaatctcggggtctgatttcagcgtgataatcggctcatcatttagtatcgtgagcagcaaaaataccttgccccgcactttgtacacttcgtgctcgggtccgaaaggaaactctttggtgctcaggggaagagtcgccgcgtgcgctgcagctaccttgtgcagatccatagaaactattgaactcgcttagtccactcctcggtggcgtatttggtttttactaggtcgtggcctgccgcgaaatcttcatcgctgagctctacttcttgcgcgccgtacctagcactgaatgtggactttagggtgtcgatgatttgctcacgtgatgcacctgtttggcggcgcagaggatcaacgcgcttctttgcgctgcgaagacccttgtcggaaatcttcacctttccaatgcgcaacacctgggtcatcatgtccgcatcgatgtcataggacatggtcacgtggtggaggactgcgccactgcgacgtttctgtgcagcgccaccgatttttccgccggtggaggtgatgtcattgataggcacgtaccaagcgtcaacatcgtgtgtcttcagcgcagcaatcacccaacgatccaaatattcataggactgctcatagctcaaaccagcaacgagagattccggtgcatacagggaataggtgatgcagttgccgccctccataaacattgcaccgccaccagacatgcgtcgtaccacggtcacaccatgttcattaacgccttcttggttgatttcattgacatatgactggaaactaccgatcactgtggcgcgatcatcccaatcccaaatgcgcatcgtcgggccacgctgaccactggcaacttggtccaaaaggagctcatccaacgcaacgttaagtggggtaggaagcacccctgggtgcaggatttcccattcataatcggtgaaatcttgcgcgccggtgactgcccgacgcacagctaaagcaatatccgcagtgctaaagccgtgtagctcaacgtcatcatattccgccaacgctgcatccaactttgcctgcaaacgatcagtgttatcacccaccgacgccccctgcagcgcccggccaagggcgaagaatgcctcatcgggttcgaggaagaaatcgccggaaatcttcacgtcagcaatggaatccagatcggtggtcacatcaacgacgacaagctttccaccaggtactttgagctcaaaatggttattcatgcgccccacagtaaccgaatttgctaaagagattttgcttgtcgacgcgcccctccatcacagtcatcccgccgcaggcgggcgtcgaaaagcggcgacctgcggatctgtgacccgcgccataaatgggtacgatggcggttggaaaattccgtaacttctttgagggagaaacccatggtcggcacgatttccacctacatcgcattcaatggaaacaccacggaagctctgaaacattggcaagaggtttttggtggtgaacttaatcttttaacctacggtcagctcaccttggaaggtatgccgtttgatcctccagcggatgcgttggcgcacggcgtcctcacgttggacaatggtggtttgatttctggcagtgattcttttgagggagaaatgctcgtcaaagacaccgcgtactccatgttgtataacgcggagtcagtggaagatggtcgcgcgcggatcgacaagattgtggcggctggcggtgaggaagccatgaagtttgaacaggctccgtggggcggtttctttggccaggtttttgataaatttggtgtgatgtggaatatttcctcagactaaaagcataaaaagatcgttgcattttcaacctcaagaaaatgcaacgacctttttcagtgttaaaacttaagcgttctcgcgatgcctcagagtcttcgatgcggagaaaatcagcgcgcccagcagaccgacgccagcgaaagcgaagaagccccatgggtaagcaaggttggcactgacaagcagaccaccaagcaacgggccagagatggcgccgaggcgaccaattcctgcggagaatcccatggcggttgcgcgcatcttggcagggtgattctcaccaacgaaggcgtagatgagtacctgggagctgaacacaaagatgccggtgagcagcacgatgccatacagaccgatcagtggcatccggacagcaagcaacgcgagggaaaatgcagagaacacgaaccatacgagtgctgttttgcgaggggagttcttatcggcaattcgccctgcaatataaaggccgatcactgcgccgatgttgagcaccatgaggaatccaagcgagttacccatgtcgtagtctgcttggcgcatgatttgtggcagccatgtgttcaggccgtagaccaggaggagtcccatgaatgaggtgccccaaatcgccagggtgttgcggcggaacgagggcttgaacagggaggaaagtgaggaggactcgccgagttcttcttcgtgttcgcgatcaagatcatcatccagggaaagtccataagatgctgcaactgcctgcgcctcatccaacttgccggagattttgaggtactgcggggattctggaaggaagaagtacagcagtggtagcaggatcagtcctggtacggcacctgcgatgaacatggagtgccaaccaaagccgtcgataaggaagaggccaaggaaggcggttgctactgcgccgacgtggtagccggtcatcaaggtggtggatgcagagcccgctttggtgccggggcggaactcggtcaccatggcaattgcggtggggagtgctccaccaaggccaacacctgcgaggaaacgccacaggctgaagagctggacgttggtggtgaatgccagcaggagagtgaatacagaaaatactgccacagagaacagcatgacacggcgtcgacccagacggtccgttaagaaaccgatggtcagtgcgccaatggtcatgccgacgaggccgatggtggaaatctgtgtggcctgtccagcagtgagatcccacgcgggatcctccagcatggacgggattgttgcacccaggacgactaggtcaaagccgtcgaggacaattgcgaaccacaggagtgcgagaactgttccgacacttttggttgcgcgggttggggtggtcgttgacacgagcgtttatacctcgaagcgtggtaggtcgcgcccaacgtactgctctgcgaggtagcgttggccggattgggattctaggacggagcgcaattcagcgaatcggcgctgggtggcaaagtgatcttcgccgggtactgcgtggagcatggagctcatccagtaggagaagtgctgtgctttccagatgcgggggactgccagggaggtgtagctatcgagcaagccggtgtccttcttcttcagggcacgaaccagtgctggcgcgagtactgagacatcggcaacagccaagttgaggcccttagctccggttggcggcacggtgtgtgcagcatcgccagcaaggaagaggcgtcccttttgcattggttcggtgaccgcggagcggaaacgcagcacggccttgtcaaagatgcgcccttcagacacggtgatgccaggggagtccgcacgcaggtgcagctgttcccaaatgcggtcatcgggccacatgtctggggtgtcgtcagggttgcactgcaggtagtagcgctggatttcatcggtacgggtggagatcagcgcaaagccctcagggtgggttgcgtagatgagttccttttgggtttttggtgcttccaccaaaatgccgaaccatgcgtaagggtattcatggcgggcgcgcacgccaccgtcttcggtgatcagcttgcggtaaggggagttggagccgtcagctgcgatgacgtagtcggcggtgatggtggtggaggaaccatcggcttcggtgtaggtcaccttggcgaggtcgccttcgtagttttctacggaatcaacagtggtggtgaaaaggagttcgccgccatcttcgatgcgcttggcaatgaaatctttgaggtattcgtgctgcgggtagatcgcaaccttgtggccggtgagttcggtcagcggaatgcgggtgcgctcattgttgatggagatgtcgattgcttcatcgtgatcggcttctgcttccatgcgtgcgccgactccggtttcgcgcatcagattcagggtgccttgttccaggatgcctgctcggacggtttcttcgacgtccttgcgggtgcgggattcaaagacgattgattccacaccttgaaggtggaggaggtgggcgagggttagtcctgctggtcctgcgccaataattgccactggtacgtggttcatggggaactcctttcattgacccactggaggtgaagtccattaaatggtgcacctcacagtgatttgggactcaatgtaagtgaaagtgcattccgtgacaacctgttcgccttgcgaaccaggcattttctgaggttgaagtcacagccagcggaaaagcgtttcagctcatgctgccagggtgtaattaggggtgtgtgtcaggggttggggtggttatgtattaatctaggtcagtttctaggatttccaattggtttaagctactgtgaacgcgtacttaaatttcatagacacgggtgctcggtgaaaatccgggctgagatctggcatagccacgaccgtcgaacctgatccggataatgccggcgatagggaggaaaaatatggctagtcctgccatgcaaaaaactaatcaaccaaagtcttcctggcgtgttattgacatcgtcatcgcatccgttttgggtgtcgcctgcggattgattttcatcgtgtggaattccatcggctacgcctggaccaccgcatttcacgcactcacaccaggccttggcggcatcgccattggtatttggctgctcggtggtgtgctcggtgggttggttatccgcaagccgggtgccgcaattttcgttgaagtagtggccgcatgtgtctctgcagcgcttgcttcacagtttggtatctccaccatttactccggcttggcgcagggaatcggcgctgaaatcatcttcgcgctgttcctctaccgtcgctacagcctgcccaccaccatgcttgcaggtatgggcgcaggtggcggcgcaattttcctggaaatgttcttctacggaaacctcgcaaagacgatgtccttcaacatcatctattccaccactgtccttatttccggtgcgatccttgccggcctgctcagctggtacctggtccgcgcgttggcgaggactggtgcacttgatcgtttcgccgctggccgcgaggtataaatgaccaccgcacttggaacgcgcgttgttgcgcgcaactttggctaccgccatgcttcccgggaaaaccccgcgctcaaagacatcaacttcgagatcgcacctggtgaacgcatcctgctcaccggcgcttccggcgccggaaaatccacgctactcgccgcgctcgctggcgttttaggcggttctgatgagggcgtttctacgggcgaattgcttgtcgacgccccctccatcggtttggttctccaagatccagattcccaagtcatcgcctcccgcatcggcgatgatgtggcgtttggctgcgaaaacctccaaattccgcgcgaggaaatctggccacgggtggaacgagcacttgaattggtgggcttggatctaccactgagccaccccacgaaatatctttccggtggccaaaaacaacgcctcgctcttgccggtgtgatcgccatgggtgctcgtctgattctgcttgatgaacccaccgcaaaccttgatcctcaaggccaaaaagatgtggtcgcagcagtggatcgcgttgttcaggaaactggagcaacactcatcgtggtggaacaccgccatgagctgtgggtcaacatcattgaccggatcatcagtattactgacggcgaagatgtccaacctgcagagttgatcaaggtgggccagttgcctggggcgcagccgtcgacaagcaaaccgatcttgtgggcgaatgatttgctgtgcacctggggcggcctgcgtagttttgaggtgccggaaggcgcctcgacggtgatcaccgggccgaatggcgctggaaaatccacacttgcgctgaccatgggtggattgcttccgccgaaaagtgggcagctggaactctctgacacggtgcgcggcggccttaacacgcccccgcacaagtggcgttcagctgatctagctgcacgtattggcactgtctttcaggatccagagcaccaatttgtggcgcgcactgtgcgtgatgagctagaaattgggccgaaaatcatgaaagtcgatgcaagcgagcgcatcgaggagctgcttgatcgtttgcgcctccgccacttggaaaacgccaatccgtttaccttgagtggtggagaaaagcgccgcctatctgtggcgacagccttggtggcagcaccgaaacttctcattttggatgagcctacgtttggccaagatcccgagaccttcacagagctggtgacgatgttgcgtgaattaacagacaacggaatcagcattgtgtcggtaacccatgatcctgatttcatcgcagcgctgggcgatcaccacattgaggtgagcgcgaagtgaacctgctgatcaaaattaatcccgtcacccgcatcatcgcgttgatggtactgaccacgccgttgctgctgagtttggatgtgatgtcggcagcgatcgcgctggtggcaaccattattctggcaccatttgccggcgtgacctggaagatgctgctgaaacgtggctggatgctgttcctcatggcaccggtggctgcattatccatggcgctttatggcaggccggatggaaaagagtactttagcttcctgctcattcacgtcactgataattcactggctttggctgctgccattgggctgcgtgttctggcgattggtctgcccgttgtggtgctgattgctcgcattgatcccaccgacctgggcgatggtttggcgcagctgctcaaactgcctgaaaggtttgtcatcggtgctgtggcaggaagccgactgatgacgctttttcgggaagattggtactccatgtccagggcaaggcgtgcccgcggaattgctgatcagggcaagatcaagcactttttcaccatgacttttggtttgttggtgctctcgcttcgccgtggatccaagcttgcaacggcgatggaagcacgcggttttggtcgcacgactggccgcacctgggcaagggaatccaccgtcggcgcgcgcgatctggtgctcatcttggtgtgtgctgccatttccgcgatcgctctaaccgtgtccattcagactggtttctttaagttcttgggcacatgatcacagttttaattgatggacaatccggtgcgggcaaaaccaccttggcgggtgagttagctgcccgcaccgggtttcagttggttcatttggatgacttttatcctggttggactggccttgaagcggcatcggagattgttgcacgccatgttttggacgcggacaaccccggtttcttcacgtgggattggcacaacaattgccaaggcgattggatcaagttggagcctggtcgaagtctcattatcgaaggctctggatcaatcactgctgcaacaaaacgcaaggcatcgctgttgggcgagctggtgaccgttcgtatcactggtcctgaggctttaagaaaacagcgcgccctcaaccgcgatcctgattacgcaccattttggaaagtgtgggcgcagcaggagcaacgccatttctctttaggcgttgaggtggatcatgagattgtgctaggttctgatgaggcttcgggacgacccgaagaaatctatgacagcctgggaacggcccagagttcttaagaaagtttgactagagaacatgccgttttcttggctaaaaccaattgattatgcccgcatctttgtcggctgggcatcgatttttatcatccccctcatcacactgccatcaattattgagttggcgctgatcgtggcagtcatcctattctgcgcatttggcgtggtgaagatggcggagcgtttggctcatattttgggtgatccttttggatcgttgatccttaccttgtcgatcgtgatcattgaagtgattttgatctgtgcggtgatgctggggcctgctgattcaaccactgctggtcgggattccgtgatggcagtgtccatgatcatcatgggtttggtcgtgggattgtgcctactcattggtggtttaaggcatggaagcatgccacacaatggggtgggaactccgacctacttggtgctgatcgcaactttttccgtaatcgcctttgcggttccagctttcaggggagaatactccactgggcaggcacttgttatttcaacactgacagcagtggtgtacgggttcttcctgtttcgccaaatgggtgcccaagctggtgaatttcaagaggtcgaggtcgcagaaaaggcagacgacgcagcaaaatgggaggtcccatttagaggcttaatcttgattatcactgtgctccccatcgtgttgctgtcccatgacatggccacggtgatggatgaagtcctggcaagccttggtgcacccgtagcaatggctggattaattattgccaccattgtcttcttgccagagaccatcacctccttgaaagctgcgtggacaggagagattcagcgagtaagcaacctcgcgcatggagcccaagtatcaacggtggggctgacaatcccagctgttctagtgatcggcgtgatcacaggtcaagatgtagttttgggggagaccccgatcaacttgttgctgctgggaaccaccattgcggtgacagccattgcgtttagctccaagaaagtcagtgctgtgcatggctcggtgctgctcatgcttttcggtgtttacatgatgagcatgttcgcctgatttaggtagcctggtgggaatgagtgcacttgagacattgcaatggcaggactggtcaagcgtcttaattgtggtagctcacccagatgatccggagtatgggctttccgcggctgttaaagaatggacagacgccggggtggaggtgtcttacctgctgctcacccacggggaggcaggtatccaaggtttagaccctaaagaaaccgggtcattgcgcgcagcggaacagcgggctgcatgtgatgtggtaggagttagaaatctcaccattttgaatcacccagattccatgttggtgtacaatctggtactgcgcaaagatattgctcgggaaatccggatccgtaaaccaaatgctgtggtggtatccaattttgatgtagaggcctacggtggtttgaaccaggcggatcaccgcgtggcgggattagccgcaattgatgcgacccgcgatgccgctaatccgtgggcgcagccagagctgttgcaggaggatctgcagccgtggggagctgaagtcatcatcattgccggacacccagagcccacccacaccatggatctggctaaagattctgttgatgccggagttgcatcccttcaagctcacaaggaatacttggccgctcttccagatcccccgaagccggaggagttcattccggcgtttctcgaggtagagggcggttacgcagcggccttccgagttttcggacggtaagcagggcgatacgtgataggcagcttatcaatcagataagaccacaaagcccacactgcacacaggagtaatacttccgcgacgatgtagaacggccatcctcccaacaaatccagaattgacgctgattctggttctgtggagaggtacccgtagttggttcccaaaaatgcgttgaccatgaggcacatgatgccccagctaatcgccactgcaacggacataaccactccggacagccctggcttttctccaaaagcgaaaatgagaattatagctgctaggaacacagaaatgtgcataaaccagtacattaaaaactccagccagggaacctgtaaatactgaacatctggagtgagcagtgacatcaggttgatcgtggtgccccacaaaatagtcactgaaactgcccaccgcgcgcgattaatcaatgcgatggcagcaataatgcgcaatgcatctgagaagtggaatggccaagattggtccagcgtgtaatagccgggcataaaattccacaggttcgacagaagtgttgcgatgagtagcacccagccaaatgccggtgcgaagttgaatcgacgagcaatggggacgacaagaatcgctaaaaccacagcggtgatgagcatcgaaatatgctcaaaaccgtactgtggcatagcgccgagatcaccagggttttccataagaaactaatctacataagctttaaggtggcgtcctgttggagtatcagttttgatgagttccgcggggctgccctcgaatacaatcgagccaccatcagaacctgcaccagggccgacatcaatgatgtggtcagcgtgagcgagcacgccgaggtggtgttcgatgacgatgacagacttgccgtcatcaaccagttgatcaaaaagatccagcaaggttttcacatcagcgaggtgcaggcctgtggtgggctcatccaaaataaaggtggtggccttgtctgccatgtgggtggcgagcttcaaacgctggcgttcaccgccggacaacgtggtgagcggctggccgagggtgatgtagccgaggccgacgtcgacaagcctctttgcgatctttgccgcaggcaaaatctttgaatctttcgccgcgaaaaactcatacgcattggcagccgacagccccaacacgtctgcgatgtccttgccaccaaagtggtagtccaacacggactcatcaaaacgcttgccctcgcacacctcacacggcgaagataccccagccatcatgcccaaatcgacatagaccgagccggcgcccttacagtttgggcacgcgccttcagaattgggggagaacagcgccggtttcacatcattggccttggcaaaagccttgcgaatcgaatccagcatgcctgtatatgtcgcaggattggaacgattagaaccgtggattgcggtttgatcgacaaacacaaccgactcatcacgcggaatctcatgaatcaacgaggacttacccgaacctgcaacgccggaaatcgccgtgaacacgccgagcggaatatcgacatccacattgttcaaattatttcgatcggccccgcggatctccagggcgccatgcggcgcacgcacggattccttcaatgacgcccggtcattaaaatggaggccagtcacggtgtcgctgtctttaagcttgtcgacgctcccctcaaaccgaatttcacctccacccgcgcctgcacctggcccaaggtccaccacatgatctgcaatggcgatggtttccggcttgtgctccacgactaaaacggtattgcctttatcgcgaagatcgagcagcaacttgttcatgcgttcaatgtcgtaggcgtgcaaaccggcggtgggttcatcaaaaacataggtgacgtcagtcaatgcagagcccaaatggcggatcatcttggtgcgctgtgcctcaccaccagacaacgtgccagcggggcgatcgagttggatatagcccaaaccgatctccacgaagttatccagggtttcagtcagtgcggtgagcaggggagcaaccgagggggcttccaccgttttgatccacttggccaaatcacggacctccatcgcgcacaactcagcgatgtttttgccattgatcttggactccaaggcatgtggcgctaatcgagttccaccacacgcagggcaaggaatgaaggtaaccgctcgatccacgaacgcacgaatatgcttctgcatgccttcgcgatccttagacaacatggatttctgaatgcgggggataagaccctcataggtcatgttgatgccagcgatcttcatcttggtgggctcaagataaaggaagttgtggcgttcttcgtcggtgaaatccttaataggcttggcagcatcaaaaaggcccgattctgaatacatccgataactccatccacctggggtgtaaccggggatggtcagggcgccgtcgttgagggagagggaggcgtcgaaaagctctttgaggtcgatgtctgaggccctgcccatgccctcgcacgctgggcacatgccacccgtgcgtttgaaggtagctttctcccgcttggtgtttccgcccttttccaccgtgatggcgccggatgcggaaacagaggggacgttgaaggaataagctcccgggccacccgcgttaggttccgcgattcgggaaaacaaaatgcgcaacatcgcggtggcatcagttgcggtacccaccgtagaccgtgggtttgcgcccatctgctcctgatcgacgatgatcgccgtggtgatgccttccaaatggtcaacatcgggccttgccatcgacggcatgaaaccttgcacaaaagtgctataggtttcgttgatcaaccggcgtgattccgcagcaattgtgccgaacaccagcgaggacttgccagatcccgacacacccgtgaacacggtgagacgccttttagggatgcgcaccgacacatttttgaggttgttttcattcgcaccgtggaccgaaatccaatcatgggaatcagctttttgcatgtgtcatatcgtaccgtttgcataggcctgttcgcgcttggtgaaccttttctagcaccaaaacaaaactctccctagtatggggtccatggctaaaacacattttcaaggcaacgaaactgctacctccggcgaactgccacaggtcggcgacaacctcgcagagttcaacctcgtcaacaccgaactgggcgaggtctcctcaaaggacttccagggccgcaagcttgtcctgaacatcttcccatccgttgacaccggcgtttgtgcaacatcagtccgcaagttcaacgaggcagcagcaagcctggaaaacaccaccgtgctgtgcatctccaaggatcttccattcgcactgggccgtttctgctccgcagaaggcatcgagaacgtcaccccagtatccgcattccgttccaccttcggtgaagacaacggcatcgtgctcgaaggctcaccacttaagggtcttcttgcacgcagcgtcatcgtcgtcgatgaaaacggcaaggttgcttacacccagttggttgatgagatctccactgaacctgattacgacgctgcacttgctgcgctgaactaatttacttcgctcacggtaatttctgatgaagcttcggtggtctccaccggagcttcagttgtttccggttcagtttcgggggtggtcgacggagctaagagaggtgaagtttgttcagaggtctctgagggttcgtcggttgctacaggttcgcttggctcggtgggctcggttggtgctgtagggtcggtggattctggatcttccggcccgataatccacgttgggggaagagcaatgatcggcgagttagtagtgggagctggtcttcccgttgaggttttactgtcgtcaccatcgtcaattgcgtggcgactttgcgacgtttgagctggagttgtaatcgattcagatgcaggctgcactatcgacggtccaagagctgtcactgcgctttctgaagcggaattttctcgtgtgagtggcagaatggatcgatctagccatgagcggaacgtcgaaaccggtgactgcccagaggcgatcggtggtgaggcgaacatttcagagttttgcagcattgatgagctcggggaattcggcgaacttggtgaattcagtgcgcctagtgagtccagtgaggtaggtgaacttggccgcctgttagctaacgttgttacctgtacgtcgggttgagcatggttttccaggctgccctgaggaatcaatgtatcagcaaccaggaatatgataatcggaagtgtcgcgagtaatccgactgacgaggccaagttccaacgctgagtattagttgactgaattctcttgaaaagaattactaatgccagcacaaaaagcatcaagctaatgactgcgagcagcatcgcactatgatcactcaacttgtcaaagggaataacggcgaaaagactaaacatccccacgccacaagcaacatgagggctgtacttaactgcggtgtccgacaaagacagtgcctttttggacagcgtttgtggtcgcagaatctcgtctgaaaggagcgctgtcgccttcacataattttgggaatctgcctctttaggtatcaaccgagggatttttaaaacctcaaggcgatgctgcttcttcgaccacaactccagtgggagaacgtcaatctcgaaggatgtttcaccgttctcccggactacgtggccgagcaccgtgggggtgagaccatttgcatttgagaatttcacagcagagcttagtgctgaggcgtcatcaaagtttaagatgccacattctattccgttataggagacaattagggcttctaaatcaagcctcagcccaaaaagaatcgtggagccaagtgagaaatcctcaaacagagcatgaacggtgggctcaacgcgccacattctgcctagcggtaagaggtgggaatcagctcgtggaggatcattgctgatgagcccgaattttaggtttggaagaagaactgaagcgagagatcctttactcggtgtgagaagtagttggctggaaatcaggtggccagaggcaaaaattcgagacaattgagaattcaacaggaactgggactctgcaatcaccccgagaaattcatcttgaacccaaacaccgatttttgttgcggattctattggtgcgagaagcgcttcgacgatgagttcgccttgctcaggtttcacaatagcgcgtaagacatgccaattgacgcgctcgagagcgaaatgttgggcagtctgtgcagagaagaagaggtgaaggggatagatgtcaccgtcgaaatcaagctgaggagtgcctgttgaatgggtatacattgggcactcctttccttaaatttcgtgcaaacttgtgaattgattgagacagtaaaaagtcatattaactgtacagcgaaattacagcgaacaactctccactaatgagacgagttttgcgcacgctgtggaatgaacttcttgatcacactgaccacaacggtgataatcgcgccccaaatgaggccgaacacaagtgacccgaaagtattgccaacccatcccagagcactgcctccgataccgttagcccaggactctagtccgtgaacaaggtggtagggaagttcccatcctaactcttcagttccaacgaccatgatgtggccaccaacccacagcatggcaaaaacgccgacaacagaaataacttgaagaacgatgggcatcgctttgaccaagccgcggccaaatttctggatacctgcggagtcacgctttgaaagtgtaagtccgacgtcatccattttcacaagaacaccgactacgccgtacacgagcgcggtgatgccaatacctacgacgaaaagaaccgcagcctgcatccagatagtttgatctgcaatctgattgagtgaaataaccatgatctctgcggaaaggatgaggtcagttgtgatggcacttttgaccagctgatcctctgactttgggctttcctgcgacttgggttcggtgctgtgctgttcacctttgatgcgcctgtggagggagtgccagatcttttctgcaccttcgaagcacaggtaggagccgcccagcatcaaaattggtgtgagagcccacggagcaaacgcggaaagaagcaacgcgatgggcaaaatgatgatgatcttgtttaccaaagagcccttagcgatccgccaaatcatgggcagttcgcgtgcaggtttgacaccttgaacatattgcggggtaactgccgtgtcatctacaaccacgcctgcggctttaacgctggtttttccagccatcgccgtgacatcatcgaggctggctgcagccgctcgagtaattgctgcgacatcgtctaatagtgctgccaatccaccggccattgatgactcctttgtagagaaggggtagtgcttacaaatcttatctgtgctcaggcaagatagcaggtatgaaaattgcgatcgttggcgctggtgcagttggtggatatttcggagcgttgttacaagaatctggtgcagatatcacgatggttgcacgtggacgaacattagaagccttgaagtctaaaggactccacatcaacgatgcaagaggcgaacgctacgtaccaattcctgcagttgcgagcgtgcaagaactaaaagatgcagatgtagtgatgattgctactaaagcattatcgcggtctttagatctcgctgaacttttgggtgggatacctgcgaattcggtggtcgcgattactcagaattcgattgaatctgctgatctagcagcgaagagtatcggtgctgatcgtgtgtggcctggtgtggttcgtgggttctttgttcatgaggggccagcctcagtgtcatacaagggaggcccactgtcctacacgtttggtgattctggtgaactttctaggcaattcgcaagcactcttgaacaggccggtattgacggagttctgcatcccgatattttggtggatgtgtgggagaaagccatgttcgtagaggttttcggcgggttgggggctttcgtcgaaaagcaattaggtaccttgcgtacgcattttagggcttccctggaagccttgatggaagaggtggctgaggtggctcgcgcggcaggtgttgcgttgccgagcgatgcggtggagcgcaccatgaattttgcggatcggatgcctgagaattcgacgagttcgatgcagcgtgatttggccgcgggagtggctagtgagcttgaggctcagacaggtgcaattgtgcgggcagcgcacaaagtgggtgtgaaaactccgcttcatgaccttatttatgctggtcttaagctgaaagaagaggaaaattcactttagggatagaatcaagatccatgatcgttacatccaccgcgcgcgtttctatagatcgtccctcgcgctatgccaaacagttaactagccatttgggtgaaaaactgagcacaagctgggacccggaggcagaacgggggtctgttgtcttggtgggaaagggcccagaccacgaagaccagcggtttgcttttgatggatctgctacctgtgatctggttgccggcgacggcgtgctgttgctccacattgaatcgcccgccagcctggttgagcgttttgaaaatgtcatcggcggccatctggtcggcttcgctcggcgcgacgagatgaagattgcttttcgacgtggtgatggatcagaagggctgtcttttgagtccgtctaacataatccgcatcgcagctgttctaatccccaatgatcaggatcagattctctgcgtccgcaaagagggaactgaattgttcatgtttcccggaggcaagcaggagttgtgggagactcctgcacaggcagccgcgaactcgaggaagaagacctcgatctttatgggcgttttcaggcaccggcagcaaacgaacctggcttctatgtggactgccatgtgtttagcacatttgatgtgttcttgaactacacaccggatgtgtacgaagaactcgctgaggcgaagtacttctcgcctaaaccacgatcgaagaagctcgcgccactaactcgtgacgtatttgaggctatctcaagtgaagtgcgttaagcactatcgttttaggcaacgaaaaatagcagtggcacagcagtacagaccatgaggcccccgatcaaaatgaggaagaacctcaaggtgacgtccttgcgtgcagtgaggcgccgaacctgagtggaatcgtctctgttcaccagcaagggaatcacggcgcctttggtggtgatgggtcggggagtggacttcggtagaactccgaacacctcgtggtggtcaagctcgaagcggtactgcgtcagatagcgttcgtcttcgagctcaacaaatccagttacttctgcctcgacttcgaccgcattagattgaaaatgccgatcttttccgatgaagtgaattcctataccgatgcagactactcccaggataaggactatcagcagggagatcagcatattctaggagctgcccagcgcccaaccaccgatggatgaaccggtgaaaggctgtggagcagggatgaaggtggggttggcggtggcgtcaacaagttctgcgggcgcaccagcaatgggggcaatgtgcttgccggtgtagtaggcgatccactcggcgtgttcagcaacggggatgtaccagccgacggtgccgtctagtgcatcgttttctacgtcagtggacatgctgagcacaccagccagttgaccattgatgtacaaaggtccgccggaatcgcctggtacgagacgaccgttagaaacagtgccttcaagcagcacagcggtgcggtcggggcttggcacattgactaccctgcgttgaatttgcacatcggcttgctgtgcaacattttggccaaaggcagagtacccaccccagccggctgcttgaccattttcaccaggctgcacgtgtgcaccgtagagatcaaccgtgttggaacttgcctgattgggaagctcaacgagagctaagtccgcagtagggtgcaagatcgcttgggacacctgctgaaattggctcaaagtgcttgaaccaatagctgcaccggcaataccgccctcagggatacagtggcgggcggtgatcgcccacgttggggtgatcatggttcctgtacatgcagtgttaccgatgtgcagacgaacaattgaatctgaagtggtgcttgaacccgtaacgttgcgagcatttgccaaagcatgtgcaggtgacgccgccactaagggggcagacgcagccgttaaagctgcgagtacggacagtgctttggtggtaaatgacgcagaagacataaagaacagtctagatggttgctctacaaaatgttgtcacaagatgctgtcaatgacgtcgattttggggcgcgcaatgcgcgcgcctttggccgtcaccacgatcggacgctgaaggagcctgggatgggcaacgatggcgtcgataagctcagtttcaggtgtttctggtgacaggcccagttctgtgtactcagcttcgcgggttctgatgccgtcgtggactggaattcccagcgtattgaatagttctttgagctcggaagcggtgggcgtgtctttgagatactgaacaatttcaggctcaatgtccttgtcgcggaggtaagcgagggtatttctggatgtggaacaacgcggattatggaaaatcgtgactttcataacgttgagcctactaaggtttgttccatgattattcaaatcctaagagtggcatttgccttcgtcggcatcattgttggcgccggtttcgcatcagggcaagaggtcatgcaatattttgtggccttcggcatagacggaatttggggagtcattgtttctgcagtgatcatgtcggtgatggcgttgatcattttgcagctcggaagctatttcaatgcaggtgaacacggtgaagtgttccgccgagtaagtcaccccgttttctccaaaattttggacatcggcgttgtggtgacgttgttctccaccggtttcgtcatgtttgcaggcgcgggatcaaatctgaatcagcagtgggggcttccgctctggatcggttctgtgatcatggttcttctggtgctggctgcgggcatgttggacgtggataaagtaaccacagtcattggtgcaattactccgttcatcatcattttcatcactgccgcctcgatctacacgctggtaggtaatttcagctcagtggagcagcttgattctgctgctttagaagtcggcacgacgttgcctcactgggctgttgcagcggtgaactatgtgggattcaacctgatggttgcggtgtccatggctgtggtcattggtggatcaatgtttaacccgcgggtcgcaggtcggggcggtttgctgggcggattgatcctgggattcttgatcatcatcagtgcgctaacactgttcgccaccgtggaagaagttggccaagatgatatgcctatgctgacgatcatcaacaatttgaacccgctggctggccaagtaatggcagtggttatctacggaatgatcttcaacacggcactgggtatgttctacgcattgggccgtcgtctcactgcgaaaaacccacagcgattccgtccggtttatgtggtcacagtgctgattggttttgtgttgagctttgtgggattcaagaacttggtgggctatgtgtacccagtcttgggatacattggcctgctgctgattgcagtgatgatggtggcgtgggtgaggggacgcgtacgcatctacaaggaatccgaacgccgcatgcggatcgcagacttgttgcagatcggccatgacggagcgttgagtggagcagagctggcggtgctcaaccaggaaatccaagattcaaacttggatgaggaacaaattaaagcagcggttaggaagtagttactctgcagggacgagctctacctggctggcgtcagcccaggtgagttcgattcccttggagcgcagccactgcataggatcgtcgccgtggcgggtgattccttcaacagcattcaaggtggcatcaattgcgcgctcagcgtcatctgcagtgataagccctgctgaggttgctgcagctagttcgtcgatgtccatgactgttactggttctccgcagacagagatgagatccacgtagaggtcgcgggtggtccagatgttgtcttcgacgcgaatttcagcgacatcgatgtagtaatcctgacgttcatccacgcctttgcggaagtggaaaatgttggcacgcaatccaagttctgggaggagccagctttccaagtatccgaacttggggtggtttgcaccacgagccatgtacaggccgaagtcggttactttgaaggtgtctacctcgcggagaaaccccttgggatctgtgtttatggattcagcagtgttgaaaatttcctgctttacgggatgaagatcagtcattgttttcttacctcacatcgaatacgacggcagtcgggatgaaattacagttcgctgaaccgttttcggtggatgtggtgaggccgcctgacatggaggcgacgatgatgccgcgtcctgtgtctgccacaccggaaatcgttgaggggccatcggggttgattccggtgttgctcaacgtcgtggtgccatgggtgaagttgcttaagtttgcccattgaacagtcattgcggtgctttgctgttctgcgagggggccagttcccagtgcggtgaacacgaaggaggtttggccgacacctgcgccggggagggggagatctgctggtcctggaactgcgaaggcagatcctacggctgcagaatttccgttgatgcagttttctgatcgggtgggccagaagaactgcgcgatgcgtggtgcgttgtcggggatttcaatgtccccaccttcgctgccgtcaccggtgataaaacccatggcctgagaaacgatgttcttgatttcctgcgggacccacggttggtttactgcctgttcgatttgttggcggaactgctcgttggggcgtccccattggtctacggggagaccgctggagagattcgatgaggcgttgaaagcttgttcaactggtgtgacagccgatgctaccggggttgccgggagtgcaatggctagagcggcagcgactgtaagcagtcgggggagtgtctttgtcacttgagttttacttacctttcaacgagacaatgcggagggaacaactttagtcacattagtaacttcagttaacttcttttcctcctgtcacattaatcgcagaatatttactgtcaataaggatctaagtgaatttctgggtttccctaaagattcaccaaagatccgagacacattagaacaacgttttcttgttttgtttgtcgtacatcgatgcagttccgttacaaaattctgaaaaaaccagcaaaatctttagagatttgcctcacaatgtgcggaacgggcgataatgcgagtacagtgataccgttctaaaacaatggactcgttttacaagtcctccatacttctttatccggcaggagaatgcccccagtgacccacccagagtttcgtaacgtagcgattgtcgcgcacgttgaccacggaaagaccacactcgttaatgccatgcttgaacagtctggcgtattcagtgaccacggtgaagtagccgaccgtgtgatggactccggtgacctggaaaaggaaaagggcatcaccatccttgccaagaacaccgcgattcgtcgtaaaggcgctggcaaggacggcaatgacctgattatcaacgtcattgacaccccaggccacgctgacttcggtggcgaagttgagcgcgcactgtccatggttgacggcgttgtccttctggttgacgcatctgaaggcccactgcctcagacccgattcgtgcttggcaaggctcttgctgcgaagatgccagtcatcattgctgtgaacaagactgaccgccctgacgctcgtattgacgaggttgttgaagaggcacaggatctgcttcttgagctcgcatctgcacttgatgatgaagaagcagcacaggcagctgagcagcttcttgatctgccagttctgtacacctccggtcgtgagggcaaggcttccactgagaacccaggcaacggcaacgttcctaattccccagatctgatgcctttgtttgagaccctctacgaggttctcccagagccaaccgctgacattgatggccctctgcaggctcacgtcaccaaccttgactcttcctccttccttggtcgtatcggcctggttcgcgttcacgcaggtaccttgcgtaagggccagcaggttgcatggattcactacgatgaagaaggtaaccagcacaccaagaccgctaagatcgcagagcttctggctaccgttggcgttgcccgcgttcctgctaccgaagttgttgcaggtgacatcgctgctatctccggcatcgaagacatcatgattggcgataccctcgcggatcctgagaacccagttgcactgcctcgcatcaccgttgatgagccagcactgtccatgaccatcggtgtgaacacctcaccaatggctggtcgtggcggcggagacaagctgaccgcacgtgtggtcaaggctcgtcttgagaacgaactgatcggtaacgtgtccctgaaggtcaacccaactgagcgcccagatacctgggaagttcagggtcgtggcgaaatggctctgtccatcctcgttgagaccatgcgtcgcgaaggcttcgagctcaccgttggtaagccacaggttgttacccagaccatcgacggcaagctgcacgagccttacgagatcatcgtcatcgacgttccttccgagtaccagggcaacgtgacccagctgctggctacccgcaagggcctcatgcagtccatgtccaccaccccaggttccgactggatccgcatggaattccgtattcctgctcgtggcctgattggtttccgtacccagttcatgactgaaacccgtggtaccggtatcgctaactcctactctgacggcatggatgtttgggctggcgaaatcaagggccgcgcacacggttccttggttgctgaccgttccggccagatcaccgcttacgctctgacccagctggcagaccgtggtagcttcttcgttgagccaggcactgagacctacgaaggtgtcgttgttggtctgaacaaccgtgaagaagacatggacatcaacccaaccaaggaaaagaagctcaccaacatgcgtgcagcttccgcagacaccactgtcaccttggctaaggctcggtctctctccttggatgaggcactggagttctgtggcgtcgacgagtgcgtcgaggttacccctgatgttctgcgcatccgcaaggtcatcctgaacgctactgagcgtggccgtgcacgttcccgtgcgaagagcctgaacaagtaattctcttttagttaagagttgctctggcccgctgtgtcctctggacgcagcgggccagtagtattttgggggtgagaataaggtttggaattctaagtgttgtcgcctgcacggtttcgttggtggcatgtcaggctaatccgggtcctgcgcccgttgaggagccaactacagccactgcgacgaccacggcaactgagacgaccaccgtagagactgaagcccccaaacaagatcgggaaaccatcagtattggtatcgatccgatccgcaacggtttcaatccacatttgttgtctgatgattctccactggtgcgcgatactgcatcgttggtgttgccgagtgcttttgagggcaatcagctgaacactgacttgttggacaatgttgagcaggtggatgaaaccacggtgaggtacacgattgctcaggaagcgcagtggagtgatggcactccgattactgggtctgattttgagtacttgcgcaggtccattgtggcggggacaggaacgctgaacgattctgcatattcggcgatttcagagattaggacctcaggcggtggaaaaactgtcgacgttatttttgaacatcctgtcgctgattggcatttgctgtttaacaatttgttgccgagtcatttgatcactggcaattccacattccagacagcgttttatgattccatcccggcctctgcggggcgctacatggtgcgttccattgatcgtcagcgcggcgtgattacgttgtcgcgcaatgatcgtttctggggtgcaaatccggcacacgtggaagtactccaattcaacaccgttgcctctgcatcccgggcgggggagtacctgcgcaccgggcagagttcgtttatgaatctgtcaccgcaggaaaccctggtggacacgttgaatttggtgccggacacggaagtgcgggtgtctgacacgacgcgcacgctggagctggtattcaacgccgaagcgctggcaccggcgcagcgcgcctacctgacatcgcttatcgacgtccccctcaccgccaagttagctggcggtcgcagtgcaaacctgggtgtgccccaaacggtggaggcgagcgtcgataagcaagaaattcctgcgttgcgcctggcggcggaccccgccgacgatgctggtttggcagctgcgcggggcatcgtcgatatgctggctgcggatggaatcaaggctcaggtcgtgacaaccgatttgaattcggcgattgcgggtaattttgatgcgatcgtggcgtggaccagaactgccacggattcgattgcgttggcggaccgagtgggttgtggcgtgaacttggcaaagtggtgcgctgagggaaccacggaatatatcaacggtgttttggcgggtgagattgatttcgatcctgcgtgggagcagcagtttaacaccgagaatcacttgcgggttccgatcctgcgggagactcgggtagaagcgaaaaataacggtatcctcggggctgcggatggctggcctgggggaatttcaagtgctgcaagttggaggaaaaacgatgttgaagaatgatctgtctggtgctcgagttgtagctgtgcatgcgcaccctgacgatgaggcgattaccaccggtggtgtgcttgcggatcttgctgctcgtggcgccgatgtcacggtaattacctgcacgttgggcgagcagggtgaggttatcggtgagacattcgcgcagctagtcaacggtgatgcggatcagcttggcgggtttaggatccatgagctttacgcctcgctggagattctgggcgtgcgtggcattcatctgggtggcgctggctgctggagggattccggtatggttggtgatcctgcaaatgagcatccgcgtgcgtttattcactctggtgaccgtgcagtggagcaattgaaagaacttcttgcggaattgaagccacatcttttgatcacctatggccctgacggcggctatgggcaccccgatcacattcgtgcgcatgaaatcacccacgcagcagccggcgagcaacgcattctgtgggctgtgagcgaccgtgaggagctcgaggacggtctaaaggcaatcactgggcttcctgaaggttggggcaggggagagctctctgcggtcgattccgtggacctctctgttgagctgaacgatgaagtgtatgccaccaaggtggaatccatgcgcgcgcatgcgacacaattgtggatcgctgacggttccgtatctcgcaccaacccggttgccgcacacgcagtgacacagcaggacaatgtgaaggtgtgggcgctatctaatttgattgcacaacccatcatgcgccacgagcactaccaactcggcgccggaacaccactgcctgaaggtgcaactggagtgcttgacggactggagttctgacacggttatggcagaatctaagcaggttcggaacaagagtttcattcaccgaaacctcggcaaaggggaggtgtttggaggtctattttggctcagtctaggggcacttatttcggtgcttttggaggtcatttacctgggcacccggatcactttgcctggcggaacatcgctggcgtttccctacacaatcgccattgcattcttgttcaatatggttttgaccaggacttccatgctgtggaccgatcattggcttgcaaaattcactccactgacagtgtggattttagggttcatggcgctgctggtgtggaccgtggttgcaggggatcaattaattccgaataatattcgcacagtgctgctactttttgctggtttttccggtggaatttggcctgcggtcaaggggaagtagcataataagcctaaagctttcccatatttattagcctcttagagttctcaggagaaaacgaaatcccatgacatacacaatcgcacagccctgcgttgacgtcttggatcgtgcctgcgttgaagaatgcccagtagattgcatctacgaaggtaagcgcatgctgtacatccacccggatgagtgcgttgactgtggtgcatgtgagcctgcttgcccagttgaggcaatcttctacgaggacgatgtcccagacgaatggcttgactacaacgatgccaacgctgcattcttcgatgatctgggctccccaggtggtgcggctaagcttggaccacaagattttgatcacccaatgatcgctgcgctgccgcctcaggcataatctaacgcatgacctctcgcaccccgcttgtttctgttcttcctgattttccgtgggattcgctcgcttccgcaaaagccaaagctgcgtctcacccggatgggatcgtgaatctttctgttggcactccggttgatccggtcgcgcccagcattcagatcgcgttggcagaagcagcggggttttcgggttaccctcaaaccatcggcaccccggaactccgcgcagccatcaggggcgcgcttgagcggcgctacaacatgacaaagcttgtcgacgcctccctcctccccgtcgtgggtaccaaggaggcaattgcccttcttccattcgcgttgggtatttccggcaccgttgtcatcccagagattgcgtacccaacctacgaagtcgctgtcgtggccgcaggatgcaccgtgttgcgttctgattcgctgtttaagctcggcccgcagatcccgtcgatgatgtttatcaactcaccatccaaccccacaggcaaggttctgggcatcccacacttgcgcaaggttgtgaagtgggcgcaggaaaacaacgtgatcctcgcagctgatgaatgctacttgggtcttggctgggacgatgaaaacccaccgatctcaattttggatccacgtgtctgcgatggcgaccacaccaacttgatcgccattcactcgctgtctaaaacctcaaacctcgcttcttaccgcgcaggttacctcgttggcgatccagcgctgattggtgaactcacggaagtccgtaagaacttgggtctcatggttcctttcccaatccagcaggccatgatcgcagccctcaacgacgatgaccaagaggcagggcagaagctcacctacgcgattcgtcgagcaaaactcatgcgcgccctgttggaatccggctttcaggtagataattctgaagcgggtctgtacctctgggcgacgcgtgaagaaccttgccgtgacactgtcgattggttcgctgagcgtggcattctcgttgccccaggagacttctatggccctcgcggagcgcagcatgtgcgtgtggcgatgaccgaaaccgacgagcgcgtcgacgcctttgtttctcgcctgagctaaacacgactaagcttattttgtttaattgagtttgaagttttccgtcgaaagaggccatttgagttccgagtccagtcctgagtcgagtaccgagcaaaaaacctggggtagtcgatttcttcgcgcttcccggcagttcatcaagttcggaatcgttggaggctctggcactttggttaacttggcggtggcagcactgtccaagaagatcgcgggatggacggcagggattcatgaaagcgatgcgttcatgaatttgcttggatcggctttccatatccgttggtaccacgtgttcatgaccatcgcattcctcgtggccaatacctggaactatcagctcaaccgcatgtggaccttcaagacagcgacaatcgtgtcctggtggaggggtttcttcccattcctggctacaggtcttgtcgcgtttattgcgagccaggtggtcgcaaccttgctgatgaacgagacatctccgattgccttgtcctctgaaattttcgacgactccaccggcttccgcacaaagttctattgggcactggtgatttccattctggtttccatgccggtgaacttcattgtgaacaagtactggacattcaagaagccgaagtccaaggtcgtcgtggaaacggaccctgtctaaacttcgttcaaactctaggcccgcattagaacaaggatttgcctacatcttcttgttctggtgtgggttttcctcacatctaacaatcgaataaatgttcgaataaaaggttgaaggtgtcccacccccacggcacaatggatggcaagaacacgtgaatccaggggggatactcatgaccactgacatctacttcagccacaacaacccacacgacccatacgcccaccacaccaccgaactcaaccgcgacacccatcacctctgggtcgtcttaaccaccgactccgacgacttcgacgcagactcctttaccaccgaagtcatccggatcaccggctactcccgccacgaagtcaacaacggccttaacgccatggccgcgatgaccaacctcccacacctgcgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtgatgatccaatcctccaccctgtccaaacgcatcgccgcctggatcaaagaactcgaccccgaacccacaccagagcccataccgaaagaggactatgttcacgtccacaccactgatgaggcgacctatgtccgcatcaaaatcagcggccccaaccgcctgatcctcaatgacatcatcacccaactcaaagacacagacaccgaggacagcctgcctgaagcgctcatggcgttcctgatggagaaaatccagttaaagatcaccaagtaccttttcaccccacataagcaccctgagcaggtgtggtcaccggactacggtgacattggtcccgaagcctatgccaatgccaccctcgtgtgcgccaaggacttagatgaggtcgctggagccacggagaagagctacaccccgagtgagaagatgaaagccctgatcagagctcgggatgggcattgccgcttcccagggtgttgcgtcccggcgagtaaatgccaggtcgatcacattatcccgtgggcggagggcggcccgacagcggcgtggaacctgcagttgttgtgccagcggcatcacaatatgaaaaccgatggtcgctttactgctgatgctaatggattggcggagattagatggattgggccgatggatgtgccggcggtgaccaggccgacgggtccgttggtgaaagcgatgccgcgggggatttggggtcaggtgttgagggatcggatccaggctaggtttgagcggatccgcgtccgcgccctcaacaaagaagactagttggagtgcaaagctgtgttgagttcgacaactttggtattgggcactgcgacaacttgtccgctgacggagtcacgcctaaaaatgaggccgtttgagcccgcgagggtggaggctttgtggagggagccgtcgaaaagcactttggtgcctgcagtgatgtagaggccggcctcgatgatgcagtcgtcgcccagcgggatgccgcagccggaattggcgccgagcaggcagcgcttgcccagcgagatgacgtgctggccgccgccggacagggtgcccatgatagatgcgccgccaccgacatcggtgccgtcatcaacggtgacgccagcggaaatgcggccctcaaccatggaagcgccgagcgtgccagcgttgaagttcacgaagccctcatgcatcacggtggtgccatctgccaggtacgcgccaagtcggacgcggtcggcgtcaccgatgcgcacgcccgagggaaccacatagtcgaccatgcgtgggaacttgtcgacgctataaaccgtaacttggcctcggcgtgacaggcgcgcgcgggtgagtgcgaaaccgtcaactgcgcacggtccgaagttggtccacacgacattgttgaggaggccgaaaatgccgtctaggttgatggtgtgagggcggaaaacgcggtgggagaggaggtgaaggcgcagccatgcatcgtaggtgtcggtgggggctgcgtcggtgtcgatagttgtcgtcacgattttgcgggtgacgtttcgatcttcatcgacgccttctagaggtgtgagcgcggactggtcggtggacccgatttctggataccacacgtccaggacgtcgccggtggaggtcagtgttgcaattccggttgcggaagcagtagtcatgacgtccagaataatttctatcggcctatcagttcaagtcggaaggggtgcgacctccgcgcaatgggctgttaactgtgacgaaggacaaaagaaccaagaatccgtacacaattgccactgagtaaacctggctgcgggaggctgcgtcgccgagcatgagagcaacgagtcctgccaacaaaaccaaggtgaggatgcctaaccatgggtgcgcccacatgcgaaccgtggagatttcatcgtttgcttgcagttctttgcggagtttcaactgtgacaaagtgatcattgcccacaccacaatcaaacaaccgccaacagcgttgaggaggaaatcaagcagaccggctggattccagtactgcaaaccaactgaaacgaaggcgaagaacatggacaacagcaccgcattggtggggacgtggctggtgctgagcttactgaaaactcgcggagcgtcttgtcgattcgccatggaaaataccaaacgagaagtggcatagatttgggcgttgaaagcggaaagcagtgctagaacgatgatcgcttccatgaaaccaaccgtgccagggatgtttgccatcgccaggatttgggtgaagggggattccgcagcggtgtcggcaccattgatcgactcataaggcatgaggaaagtgatgaccaaaacagagcccaagtaaaagactgaaatacgccaaatcacggcacgcaccgccagggaaatagcttcacgtggcttatcggactctgcagctgcaatggtgacaatttcaatgccaccaaaggcaaaagccaccgcgagcaaaccagcagcaacaccagaaataccattgggcatgaatccgtgatcaccgatgaagtttgaggttccaacaaaggtggatccgggaagccatccgaaaataagagcaataccaatgatgaggaaagcgatgatcaccgcgaccttaatgaatgcgaaccagtactcgaattcaccgaaaccgcgaaccgcgacgaggttcaccacagcgaagaagaccacgcagacaagcgaaggaatccacggttcgacgccgaaccatgcacccatgatggcagcagcgccagtcatttcggcgcccatcaccataatcagcatgaaccagtacaaccaaccgagggagaaaccagcccagtggccgaaagcatcctcgccgtaacgtgaaaacgatccggaggcgggacgggcagcagccatctcgccgagcatttgcataacaagcacaacgatggctccggcgatgatgtacgccaggagcactgcggggccggctgcgcggataccaacgccggtgccgaggaacagtccggcaccaattgcggagccgagtcccatcattgtgaggtggcgggtccgaagtccggttcccagcccttcattagatttagccatgtatcaaccgtaaacccacatggcactggttatgaaaatgggtcaagctttgaggcgggcaactggctcatggaagccggattcacgcttgattgaccaatttgcttggccttcgatggagtcgatagtgcgtaactcctcatcggctgcgaaccaaatgggggtatctccatccaagacaatgttatttccgatgtcgcaattgtctcccagactgactccgatgattccggagctgacaccaaagttgcagttttggccgatgctcaacggcaaacggcggcgctgttcatctctcggggactgaatagtagaagacagtccaatctcggaaccttcaccgatgaccacaccggaactcaggcggccttccacctttgcggcacccaaggtgccggagttgaaagacacgaaaccttcacgcagcacagaggtacccggagcaaggtatgcacctaggcgcacgcgttctgcttcggagatgcggactccagggggaaccacatagtcgaccatgcggggaagacggtccacacagtagacgtggatgagtccgcgggaccgcagagcaccacgcacccactcaaagttttcaggaaggcaagggcccttgtttgtccacaccacgtcggacagcagctccaaggtgttttgcatgtgcatttcgtgggggcggaccaggcggtgggaaagcaggtggaggcgcaggtaaacatcgtgcgcgtctactggaggttgagacagatcggggataacggtgcggactgctacctgttcgacgaggcgatcttggtccagttttaccaactgcagcatccgtggggtgagttcgtttgctccgaggcgtgtggtgcccacttccaatgggtagcgttcagcccactgatccgggttgaaaatttggggttctgggtaccacgtgtccaggatggtcccgtccatggcgatatttgcgattccaactgcttgggctccgcgaatgttttcactcattttttaatcgaccgcttccatcatgttttaactaaggtttgtaggcttaaacctgtgaactctgaactcaaaccaggattagatctcctcggcgacccaattgtccttactcaacgtttggtagatataccgagtccgtcgggtcaggaaaagcagattgctgatgaaattgaagatgcccttcggaaccttaatctacctggtgtagaggtcttccgcttcaacaacaacgttcttgctcgcacgaacaggggattggcctcgagggtcatgcttgctggtcatatcgatacagtgccgatcgcggacaatctgccaagccgtgtggaagacggcatcatgtatggctgtggcaccgtcgatatgaaatctgggttggcggtgtatttgcatacttttgccaccttggccacgtcgactgagcttaaacatgatctgacgctgattgcgtatgagtgcgaggaagttgctgatcacctcaatggtttgggccacattcgcgatgagcatccggagtggttggcggctgatttggcgttgttgggtgagcctactggcggctggattgaggcgggctgccagggcaatctgcgcatcaaggtgacggcgcatggtgtgcgtgcccattcggcgagaagctggttgggtgataatgcgatgcataagttgtcgccgatcatttcgaaggttgctgcgtataaggccgcagaagtcaacattgatggcttgacctaccgtgaaggcctcaacatcgttttctgcgaatcgggcgtggcaaacaacgtcattccagacctcgcgtggatgaacctcaacttccgtttcgcgccgaatcgcgatctcaacgaggcgatcgagcatgtcgtcgaaacgcttgagcttgacggtcaagacggcatcgaatgggccgtagaagacggggcaggcggtgcccttccaggcttggggcagcaggtgacaagcgggcttatcgacgccgtcggccgcgaaaaaatccgcgcaaaattcggctggaccgatgtctcacgtttttcagccatgggaattccagccctaaactttggcgctggtgatccaagtttcgcgcataaacgcgacgagcagtgcccagtggagcaaatcacggatgtggcagcaattttgaagcagtacctgagcgagtaaccgcattcggggttatcgtgggacttccgaaatgtaactagagactagaggaggaaacacgatggctcctaaacaaactcccagcccagagaagaatcgaaacctggtgggaccagttctgcaacgtcggcagacagagggtacttttgatcaacgcttgctagaaatgcgcgctgatcacaattggaagcacgccgatccatggcgtgtactgcgtattcagtctgagtttgtggcgggttttgatgccctccacgagatgccaaaggccgtaaccgtctttggttccgcacgcattaaagaggatcacccgtactacaaggcgggtgtagaacttggtgaaaagctcgttgcagcggactacgcagttgtcaccggtggcggtccaggtctgatggaagcccccaataagggggcaagcgaggccaatggtttatcagttggtctgggcattgagttgccacatgaacagcatctgaacccttatgtggatttgggtctgaacttccggtacttcttcgcacgcaagaccatgttcctgaaatactcccaggcttttgtgtgtctgcctggtggtttcggcacgctcgatgagcttttcgaggtcctctgcatggtacaaaccggcaaggtaaccaactttcccatcgtgctgatcggcactgagttctgggcaggtttggtggattggatccgtcaccgcctggtagaggaaggcatgatcgatgagaaggatgttgaccggatgttggtcactgatgacctggatcaggccgtcaaattcatcgtcgatgcacacgctggattggacgtagcgcgtcgccacaattaagcagtggctacattaggtgttatgagttctttgccggtcatcatggccatcgtcaatcgcaccccggattctttctatgacaagggtgcgacatttgaggacaccgctgcgctaaacagggcagcggaggtcattgaacaaggcgccggcattgtcgatatcggtggggtgaaagccggcccgggggatttcgtgtcggcggaggaagagatcgaccgcgtggtgccaatcatcgctgcggtgcgagaacgttttcctgacattgatatttctgttgatacctggcgggcgtcggtggctgatgtcgcagtggcgcatggagcaacgctgatcaatgacacttgggccggccatgatcatgagttggtgcaggtagcagggcagcacaaggtgggttatgtctgctcgcacaccggcggggtgattccaagaacgcgaccatatcgggtgcatttcgatgacatcgtggccgatgtaattacggagaccaccaaattggcagagcaagctgttcgtgccggggtgccagaggaacgggtgtttattgatcccacccatgatttcgggaaaaacaccttccacggactggagcttttacgacggatcgatgaggtggttgccacgggctggccggtgctgatggccttgagtaataaggatttcattggggaaactttggaaaggggcgtcgataagcgtgttgctggcacgcttgctgccactgcctgggcggcggcgcgcggcgttgcggcttttcgcgtgcatgaagttgcggaaacctttgacgttttgcagatgacggcggcgattatgggcgatgtggcgccacttaacaccattcgggggcttgcgtgagcagcgtaagcgtggtgattcctgcgctcaacgaagctccaaccgtggccaaagtcgtggaggcggtcctcgctgacaacccactggaagtgctggtcatcgacgccgattccaccgacgcaaccgccgccgaagcccgatccgccggtgcgacggtgctgaattggcgcgaaatccttgataccgaaccgattccaggcaagggcgaatcactctggcgaggtgttgcagcagcgcgcggagacatcgtcgtatttgtcgatgccgacctcaccagcttccgccccggcatggtgaacagccttgttgcccccttcctaaacgatgacattcacctggtcaaagccgattatgtgcgtacattcggtgatcatacaacagggggtggacgcgtcacggaactcaccgcaaaacccctcctccgcgcgcttttccccgagctaagccacatccgccagccgctcggaggcgagtacgcgatccgccgcagcaccgcgcttgccatgccttttgtgtccggctacggcgtcgaagtgggcttgcttatcgacgtcgccacccaatttggcacctcgtctatcgcccaagtagacctcggaagcagaagccacaaccatcaatctttggaagcgcttggctcgatggctgacgtggtggcaacaactattttgcagcgtttcggacatgatctcccggtcgtgcagcgtgaacccttgggtatccactaaactgggcaaccatgctgacctggataatcatgatcattgtgttgatcgcgctcatcgtgattttcacctgggtgttcgccaaactttttggtcggggagaacaaacccaaccattgccggaaaacaatgagatcgttgagcacaaccggcaggcggtgggcgaggggaatatcgataagatcatgttcgataccgtgatcagaggctaccgccaagaccaagtcgatgatgtgatcgagcatctaaaatggcaggtagattctttaaatgctcagcttgagcaggctcaccttcgggcaaaaactttcgaaacgggctaaaataggaagttagccgcgttgaatcgcggattttatcgttgtgaggagatggaatcaatatggcagctatgaagcctaggaccggaagcggaccaatggaagcggttgaggaaagtcgcaagattgtcatgaggattccatcagacggcggcggacgtctcgttgtggaattgaataaggaagaagcagccgaacttggagctttgctgttggaggcagccaaatagtcccaatgtaaacgcactgggtagtatttgtttaaccatccacctcaaggagtaaaacgcacgtgctttcccacatcattgatgtcctcgccgacccgatcgatggcaccccacttgtaggcgccgaagatttctcacggttggtgtctgaatctgggcattcctacgatgttgctcgtcaagggtatgtcaccctggctggtggcgcaggtctgcgctattcaggcgatgatgcacagatgatcgcggatcgggaaaccttcctttctggcggtcacttcgcgcccttcgtggaagctgtcaccgagcatgttcaagatgtcgttgaccaggcaggccttagcgatgacgcacagccagtggtctgcgaaatcggcgcgggaaccggctactacttgtcccatacccttgattctgttgcaggatctcgcggaattggcattgacgtttccgtgcacgccgcaaagcgtttggcaaagtgtcaccctcgcgtcggcgcagtcatcgcggacgcatgggcacgcctgccgattgcagataactctgtcgatgccatcacggtgattttcgcaccacgcaacgctgcggaatttgcccgcattttgaagccaaagggacaggtcatcgtgcttaccgcagataccggccacttggctgagcttcgtgaaccactgggcatcattgatgtggaggccggcaaagttgatcgcatgatcgaacaagcggcaggccacctcaagccagttggcgaaagagacttggtggaatttgaaatgctgctggatcaaaaatccattgcatctcagatcggtatgagcccttctgcacgccacattaagcctgaggctttggcggaacgcatcgccgctctaccagaacaaatgaaggttacagcccgggccaagatcaccaggctggaacgcatctaactcttatctcactgggccttcatgcggttcgttttcatcgaactgcatgagcgcagtgagatcatctatatctagggacaccgaactgaaatcaacagggaagtgactttcctggcgaataatgcttgcgtcaccggtggtggtgacctcaaattcgctgaatggtccgttgttgaaatacacacggcttgccattgatacataaccgccatcagcaaaaacttctactgtagagccgtcaacgacaatgaacagtgaatctgtttcatcatcagtcaatggtgcaatcgcgtgtggatcacccgcgtggttggggttcatggaccgatcaacgactagctgattgtggcggtgagtgattgttgcagcgatttcaccttcttggtccttcaacgccacttcaactgcgctgtttgatgggatttcgcacagtccggtccaacctgccgctgcctcggattcatgaatggcatcaagcaatccttctggaggggtctggaagaccgtaccgtcctggagcgtgacaatacgtgggaaagaaatagcgtttgcccagccttcttccttccaactgagatgctcagtgggggagtccaaacgacctacgccattcatgagaccaaagatgtgggcgaagtcgtagccgatggtggtttcggcgtagttggtgttgcgggggcgagagaaatcatggccaaaatcgatgcgggtaaatggagtcttcacatcgaattctgagccgttgagctggcctaccaggtatcccgaaatgtcaatcccgtcttgttcaatggtgacaatgaggacatcgtagatttcatgatccacttcatcgcgcagacgaatcatgcgaggagcaactagaacttcgtctgactctaatccagagaggccgttgagagacaggggacctgtaatggaccattctcttccatctggcgagtcgaggaccactactgttggggcttcaactgggccagtaactgcgagcatcaaccatcctgagtggccttcatcgcggtttccttggtcttcccaacctgggataacgcacggtgagcggaactttacataaccatcagtgttgccaaccacttcgccgattcgggagacatctggatcgagccccagctcgtcctcattgatcagttcggtggtgccacggatgttgttgatgtgtgccaactggatagtggaagtggggccaacaaccgaggtgaagtacagatcaacgccaccgttgttggacaccactgagccagcgcgaacctgggtttcatcgccttcaggggctagcacgtcatcgcagatatcccacacaaatggagtgcgctctgcgaattggtgcgcccacctggggccgtgatctggtgagggacggtactggtggaagaaatgccacgtgtcgtcatccaacagaacgcctgcaggtgcaaacaaaacaccactttcagcggtgatgtgcagctctggtcggtgatacccggaaacgttcgtcatctctttattgtcctgccttcactcaattacgccagtgtctttgattcagggtagcgatttcatcacacatgggtggataatcccaggtgaaggcaggttaaccccgatgagaaaagccggggagaggttccccggctttcggttttacatcaaggatttgtacacatcaatggtctgctgagcaatcgttgcccaggagaaatcattgatagcacgttcgcgccctgcgagaccaaatttggctgcggtctctcgatcagcgaccattttattcaccgcttcggcgatatcgcgctcgaaggtttcgacatcattttcgtcgtagtgaacgagggcgccggtggtgccgtcgacaacaacctcagggatgcctccaacgtcggatgcgacaactgcggtgttgcaggccattgcttccaagttcacgatgcccagtggctcgtaaatggatgggcacacgaaggtgtcagcagcggtgagaatctcttggattttgtccttgcccagcatgtcctgaacccagaaaatgccttcgcgctttgcctggagttcttccaccagggcggtggtgcgagctgcgatttcgggggtgtctggcgcgccggcacagagcacaagctgcacggactcgtcgaaaagcgctgctgccttgatgaggtgctcgacgcctttttggcgggtgatgcggccgacaaatgcgacgatgggccgctgtgggtcaacgcctagggagcggagtacggaatcttccgcgtcatcgaaagtcgggcgaggctgccacaactcagtgtcgatgccgttgaggacaacacgcacgttgtccggctcgatgcgagggtacgcagcgaggatggaatctttcatgcgagccgacacagcgatgaccgcgtcagcgtattccatggcatttttttcagaccaggaggacacgtcgtatccaccgccaagctgctcacgcttccatgggcgatctggctccaaagagtgcgcggtagccacgtgaggaatgccgtggagacgagctgcaaggtggccgccaagacctgcataccaagtgtgtgagtgcacgacatccacgttgtttgcagcttctgccatgcgtaaaccggtggacagtgtcttaatcgcagggttcgcgctttccaaggcaggatcgacgccgtggacgaaaactccctccatatcgcgaggtgcacccatgcagtgaacatcaacttcagcgatctcacgcatgaatcgggtcaattcggtgacgtgcacgccagcgccgccgtaaacctctggtggatactctcttgtcatcattccgactctcataatttcaaagattagccatctaaaaacagttgcgcagcgataccgaaatgggggcattaaaaggggctatcattcggaccccaaaacgatgtttagacaatttgttacccagctttcatgcgggatagttattttgcctttatggttaagggtgtgaagggtagaccaaatgttctagcaatcgttctcgcaggtggcgagggcaaacgactttttccgttgacggaggaccgagctaagcctgcggtcccattcggcggaacttacagattgatcgactttgttttgtcgaacctggtgaactccggattcctcaagatcgcggtactgactcagtacaagtcgcattcattggataggcatatttcattgtcgtggaacgtgtctggtccaacggggcagtacattgcttctgttcctgcgcagcagcgcctgggcaagcgatggttcactggttccgcggatgcaattttgcagtctctgaacttgatctctgatgagaaaccggattatgtcatcgttttcggcgcggaccacgtgtatcgcatggacccaagccagatgctagatgagcacattgcatctggtcgcgcggtgtctgtggcaggtattcgcgttccacgtgaggaagcaactgcgtttggttgcatccagtccgatgtcgacggcaacataaccgagttcttggaaaagccagctgaccctccgggaacccctgatgatcctgacatgacttacgcgtcgatgggtaactacattttcaccactgaagccctgatccaggcgctgaaagatgatgaaaataacgagaacagtgatcatgacatgggcggagacatcattccgtacttcgtctctcgcaatgatgcgcatgtttatgatttctccggaaacattgttcctggcgcaactgagcgtgacaagggctactggcgcgacgtcggtaccattgatgcgttctacgagtgccacatggacctgatttccgtgcacccaatcttcaatctgtataactctgagtggccaatccacacgacctctgaaggtaacttgcctccggctaagttcgttcggggcggtatcgcgcagtcgtcgatggtgtcttcaggttccatcatttctgctgggactgttcgcaactccgtgctgtccaacaacgttgtcgtcgaagagggcgcaacggtggaaggtgcagtgctgatgccaggcgtgcgcatcggtaagggtgctgttgtccgccatgcgattctggacaagaacgtggttgtccgcgacggagagctcatcggtgtcgaccaagtgcgcgatgcgcagcgcttcaaggtgagcgccggcggcgtcgtggttgtcggtaagaaccaggtagtctaaacgggaaagggaccttaaaaggtcccttttttcgcttctcgacgtccccctctaggctttagtcaccacggttaagcctgcaccaaggggcaggcgagcaacgtgtgcgccttcaatggaacgaatatattcatcggcgtcacgtgctgcttgggtgtcacgatccttgcgggtttgatccgcaatggtgccgtcaaggagcgcatcggcgagcaccagcgcaccgcctcgtcgaagaagcggccaggcggcgtcgacaagcgcctttaaatccatgggggagacttggccgaagacaagctgatagctgtcgttggcaaggcgactcatcacgtcgagcgggcgcgagagcaagaagcgtacgcggctgggggaatagccggcctcgcggaagagtgctttggcctggcgctgatgctctgattcaggatcaatgcaggtcagtgtggtgttatcggccagtccgttcaggatatacagacccaccaacccggcagccggggtaatcgcgatggcaccagtggagccgttgccattggtggtggcagccaaagtggttagcagctggccagtcatttcatccggggcggggagaccgaactcggcggcgtcttcacgagcgcgcgctacagcagcgtcggtttcagtagtggactcgacataagtgcgaagatactcgaaggcgttactcacgcgttatagtctagagcgagcaggcgagatgtgaagtacctacacgcattaagtgcaaatgaattcacaattgccagaagatgcacaggatgtaatctagatttcccaagttcagtggggcaaaatgacttatatgaaaaagaagtcccgagatgacgcacccgtcgtaatcgaaaccgttcaagcagaacatgctgaagaactcacgggcactgcagcattcgatgctggacaggcagacatgccaacatggggcgagctagtcgcagaacatgcagatagcgtttaccgcctcgcgtaccgtctttccggcaaccagcacgatgctgaagacctgacccaagaaacattcatgcgtgtcttccgctcgttgaagagctaccagccaggcacctttgagggctggctgcaccgcatcaccaccaacttgttccttgatatggttcgccaccgcggcaagatccgcatggaggcgctgcctgaagattatgagcgcgttccgggcaatgacatcaccccagagcaggcatacaccgaagctaaccttgacccagctctgcaggcagccctcgatgagttgagcccagacttccgcgtggcagtgatcctctgtgatgttgttggtatgagctatgacgaaatcgcagagaccctcggagtgaaaatgggtaccgtgcgttcccgtattcaccgtggacgcagccagcttcgtgcaagtttggaagctgcagcaatgaccagcgaggaagtttctttgttggttccaacccactaaagttggtgtgttttctgacacgacaaacgcaaatgtcgtgtcatttttgcagctcagtgcattattttggggttcgtggtgcggacagggaacttatcacaggcgacatccgttttgagtagtaggtatcttggataagaagttacccacatccttgaaagtcgagacacaggaggtcatcggaagatatgttcaattccgacaccaccgcgaatctccaagctaaaagtcgagatcgtgcaggatctaaagcaaagcgcagcaggccaagttttgattcagtagcgcgggatgttttggatgttcgaacaaaaacagcacaagttaaaaacaaggctaaagagttttcctctgttgatcacctttcagcagacgccgcagccatgtttgtagacaatgaactgtcccgtggcgccatgcatcgcgccaggctgcacattgtgcactgcgctgaatgtagggaagagattaaccgtcagcgggaaaccgttgattatctccgctcagagtgcaaaaacgaagaagtgtccgccccaatggacctcaaagcacggcttgccagcctcgccactgagtgcatgcctggccctggcgcagagaatttagcaatgcagcgcccagagtcttttgtggctaaagttgagtccgtagtgcgcgcagttcgtaagaaccaaggccgctaatttttaatccttatttacattttctgaaagaccggtctgatgttttctagcgtgggttggggagagatcttcctcttagtcgttgtgggccttgttgtcatcggcccggaacggttgcctcgtttgatccaggacgcacgcgctgcgctgctcgctgcacgtaccgctatcgacaatgcaaagcagtcgttggacagtgattttggttcggaatttgatgaaatccgaaagccactaacccaggttgcacagtacagccggatgagccccaagacggccatcactaaggcgttatttgataatgattcctcgttcctggatgactttgatccaaagaagatcatggccgaaggaacagaaggcgaagctcagcgcaacaagcaggcagctgacaacaatgcgaatgtggtggaacgtccagctgatggttccaccgcacgcccaacgcaaaacgatccaaaagacggcccgaattactcaggtggcgtctcttggaccgatattatttagcttttatttaacgccaagcccaagcgttttacccaccagcgataccttgcggtgagctaggtgttcagcgatctcattgatcgctgcagcggttggggagtgtggttcagaaatcgcaataggatttcccacatcgccaccgatacgcaggttcggatccaatggaacagatccgataaccttgacctcttcacctgtcacagcggtaagacgatcagcaatcttttgaccgccgccggtgccgaaaacatccatggtggtgccatcaggaagcaccatggcagacatgttttcaatcacgccagcaaccttctggttggtctgcacagagatcgttcctgctcgctcggcaacctcagctgcggcagcctgaggagtggtcacaatgagcaactcagcattcgggatcaattgggcaacggtgatggcgatgtcaccagttcctggaggaagatccagcagcaaaatatccaggtcgccccagaacacgtcagtgaggaattgctggatggcacggtgcagcattggtccacgccacaccacaggagcatttccttcggtgaagtgagcaatggatatcatcttcacgccgtgcgcctggggaggcatgatcatgtcatcgacctggtgtgggcgttggtccgagccgagcattccgggcactgagtgtccgtaaatatcggcatccaaaattcccacagacagcccgcgcttggctagggctgcagccaagttcaccgtcatggaggattttcctacgccacctttgccggaagcaacagcgtaaacgcgggtagtggaaccaggctgagcgaatggaatcactggctcagaagtttcaccgcgcagggagacgcggagcgcacggcgctgttcatcactcatgacatcggtggtgacatgaacttggccaaccccgtcgatgtctttgagagctgcttcagtgttggtgacaatggtggttttcatcgggcaagccgcgatcgtcaggtagacctccacctggacatcagagccgtcgatggacactgatttgaccatgccgagctctgtgatgggcttaccgatctctggatcctctacgcgggatagcgcgctgcggacagcggattcggttacttgagtcatcacgtatcgatagtagtcccaagttttgatactccctaaaattcgtctgcaacatcaccctgagtggggtcagacaaatcttgaggtcctgatccgtgctgttcgtggcggtctgcaatacgggacgctgcctcgtcgtcgagcttggcttcaatgcggtcaagaagtccgcggagatcttctaactcatggcgcaaatagtcacgtgtgacagtatctcccaaggctaagcgaacgcctgcgagttcccgtgcgaggaattcagtatcggcttttgtctcttcagcacgccgacgatccgccaaaatggtgtgcttatcgcggtcttcttgacggttttgcgccaacaggatcagcggagcagcataagcagcctgcgtggagaatgccaggttgagcaggatgaaagggtaggggtcccaactccaggcccaaccaccgatgttgaggaaaatccacaccaccacgaaaatggtttgccaaaacaggtactgtcccgtgccaaagaaccgggctactttttcggcgtaggcaccaatggtgtcatcgtcgaatttaaatcgtttgcgggatccaaaaagtgggctgtctaattcagagcggttgaaatcagccatgggtgtgctcctttcctggtcggattccggcgtcgcgccagtcttctggcagcatgtggtcgagcaagtcatcgacagctacggcaccaagcagatggcggttttcatccaagacggggccgcacaccaagttgtaggtggcaaagaatcgagctgcggtttcttgagaatcatcagcgtagagcggtggcagatcggggtcgaggatgccaccaatcaaacttgatggaggctcccgaagcagtttctgcagatgcacgcagccgaggtattttccagtaggcgtggccgtgggtgggcgcaccacaaagatcaacgatgccaaagaagtaggaaggtcggggtttctggccatcgccaacgcttcagcgactgtggtggaaggatccataattaatggctcaggagtcatcagcgcaccaacggtgtccggggagaaatccatcaaacgacgcaccggcgcagattcctcagggtccatcagatccaacaacacatcagctttgtcatcaggcagctcacccaacaagtctgcagcatcatctggatccatttcctccagaatgtccgcggcacgttcgatgtctaattcttcaatcaactcggcttggcggtcctcggacaattcctgcaggatatccgccagcttttcgtcgtcaagctcttccgtcacttcggtacgctgagccgtaggcagctgataaagctgctttgcgacgtccgcaggcctcatatcctcaaaccctgcgatgagttcggcggtgtgattggactcgccgacaccacctgcggtgatgccgtggatatgactccacggcactgtgtgcagcactgggcgccggccaaatttagggcgctcacccagcaccgccacgcgcgtgatgatccaatcgcgagtgcgcgataactccagctccacatcggcgatttctaccgcgcgaccgtggaattgttgcagctctggatcatcggtatgtacttttgcacccacaatatcgcccatgacctgcaattcaccggtgcgcacgcgaaaggttcgaagtgatacagaaccggtaaccaaagtaatgtctttcggttcaatggcagcgatacgcaacatggggacaaaaatacggcgtttattattaactagctcaaccactaatcccaatgcgcgggaatcatgcccataagggcgaatattcaccacgacatcgcggacgcgaccaatagcatccgtatcggggcctcggaccaccatcccagcgaggcggcccacgtaaagtcgggaaattccactcatgaacgcctagtctacgggaaccatttcaccagcgtgtacgttgtaaatgtgaactgaaaaagtgaaaaggaagatgataaagatgactcaaccacggcccgatgccgcatctgtgtcgctggaaaagaagcgcccagaaggatggccagtgggaagctttgaaacatacccagaagcccaagcagcagtggatttgctcagtgataatgcattccccgtcaccgaattgaccattgttggtgtggacctgattgaagtggaacgcgttacaggtcgtctcacgtggggtcgtgtgattgccggaggaatggcatctggcgcatggttgggtctgttctttggcattgtcatggccttgatgtctggattctggttctcttccatcgcagcgggaataggtatgggtttggtgtttggcattgtcggtgcagcagttccttatgctgcttccaaaggcaagcgggactttacctcttcaactcaaattgtggcggggcgctatgatgtgatttgttccccagaacgtgctcgggaagctcgagacatgattgccctgaaaactcgagatctccgccaataagttaaactaacgcctatgaaaaatgtggggaagcggattttagtccttgcgcttggtgcctcggtagcgggatgctcaacgctttcccaagaaccttcaccacctgttccgttgggaaacgttgatactgtgcagattgtctctcccaatggggagattgagtcttttgtgctggggaagctgtatgagaccgcattagtggaacgtggcagatctgcatcagttcagctgattgacggcgacttggatgagcaactatctatgctgcgagatgacagcactgatttggtgattgcttgctcaggacaattactggaatattacaacccagatttagcctccgagtttgccgtcgaatacgctaatcagacagcctttgataaaaactctggtgaatggcgcgaaaaagtctacgatgctctccaaggatcgctgccggactccatcgtggccaccgatccttccaatgctattggttgtaaggacgatacgtcgctgcctcaaaacatcgtgccaatttatagaaagcccaatctggatagggacaatcgggacaccctgaactttgtgagcggttctttgggtacaagcgatttggaagcattggtcaaggacgcccaaacaacaggcacaacctctgaaactgcgctggatttcttattgtctaaaggattttcacgctagttcagccgtggtgatgcacgtgggggcgtcatcacccgtagagatcggctgggtggatttcaggccgtcatgttcgatggtgagtgtggcatcaatgttgcgggggagccacatcccaacaaatccattatcgtaggtgatggtgtcctcttcgaggatggtttctccattatctgccaccaccgttactttcactggggtgttggcgagttcaccagtacatgtggtgaggctgtgatagaagcactcgtgggttgtggtggtgtacggggctgcggagatatagaactcatctgcaggcatgtcaatgctgagctgtccgctttgatccgacagaattaactcatctgcccgaatggaggccatgaggttagttgctctgtctgcgactggggtttgatcaagttctgtgatgatctcctgcgctgagcgtccatcgaatccctcgagctgcgttgtggaagtggaggagcagccacttaacaaaagtactgaagagatcgcgaccgcacagattcgtttcataccttccaccttaggcaaccacggcagcaaaaagggccgtatgctgtgtgattcacacggcataaggcccttctaggctagtgcaggactataaagacttaagcctcgaaagcctcgtcgataagctgcttctcctccagctggtgcaccttggcaacaccagttgcggtggaggactgagcgcggcgggaaacgcggcgcatctttggcatgttcgggatcagctctgggaggtgctcctggtagaacggccatgggccctggtttgctggctcatcctgaacgaagaggacttcctcagcgttagggtagccggcaagagcctcggagatgcggttgaacggaattgggtggagcatttcgatacgaacgatcgcgatgtcgtcgcgtccgtccttctccttgcgctttgccaattcgtagtacagcttgccggagaccagcatgaccttcttcaccttggctgcatctgcaacgtttggatcgttgatcacggactggaacttggtgacctcagtgaagtcttctggtgcggaggcagcagccttgttacgcagcatggacttcggggtgaagataaccagtggacgcttcaggtcggacagagcgtgacgacgcagtaggtggaagtggtttgctggggtggatggctgagcaacagtcatggaaccctcagcgcacagctgcaggaagcgctcgatacgtgcggaagagtggtctgggccctggccttcgtagccgtgaggcagcagaaggatcagcttggaggtctggccccacttagcttcgcctgaggagacgtactcatcgatgatggtctgagcgccgttggcgaagtcgccgaactgtgcttcccatgcaacgatggagtcttcgtttcctacggagtagccgtactcgaagcccatgcctgcgtactcggtcagtgcggagttgtagaccaggaacttaccgttgttgcccttggactgtgcaagctcgtggagtgggttgaactcttcagcggtcgctgggtcgatggcaactgcgtggcgctgggtgaaggtaccgcggcgggaatcttcacctgcaaggcgaaccaagcggccggagttagccagggaaccgaaggcgaggagctcgccccatgcccagtcgatgccaccttcggtgacagaggagacgcgcttcttagcaacgggagccacacgtgggtggtagttgaagccttctggggtgttggcgaaagcctgtcccagttccaggagctcttcacgggagatgttggtctcaaggccgtgtggaagcttctgggagccggtgatgccggtctgtgcctcagcctgcttcttgccgccttccttgacttcgttgaacacagattccatctggtcgtggaagtcgcggacgactgcttctgcatcttcgttggagaggtctccacgtccgagcaggtcttcggtgtactgagcacgaacggtctcgcggccggtgatgagctcatacatctttggctgggtcatggaaggatcatcagcttcgttgtggccgcggaggcggtagcagacgaggtcgatgaagacgtccttgccgaagcgacgacggtactcggtggccagctggccaacccagacaactgcctctgggtcgtcgccgttgacgtggaagactgggcagccgaatgccttggcgtagtcggttgcgtagtgcatggagcggctggagtctggggtggtggtgaagccgatctggttgttcaccacgatgtggatggtgccgccgacgtcgtagccacgcagcttagccaggttgatggtttctggcacgatgcccaggcctgcgaatgcagcgtcaccgtggagcagcagtggcacaacagtcttgccgtctacgcccttgtccaggtagtcctgctttgcgcggacgataccttccatcactgggttaacagcttccaggtgggacgggttagcagtcagggagaccttgatctcgccgtcgccgaacatctgcaggtgctggccttcggaaccgaggtggtacttcacgtcaccggagccaccgatctggccctgctccatttggccttcaaactcgttgaagatggatgccagtggcttgcccacgatgttgaacagcacgttgaggcgaccacggtgtggcataccgatgacaacttcgtcgaggccttggcctgcggcggtgtcgatggcggagtccatcagtgggataagtgcttctgcaccttcgagggagaagcgcttctggccgacgtacttggtctgcaggaagttctcgaaagcctccgcggcgttcagcttctgcaggatgtacttctgctctgcctgggttggctttggcattccggcctcgaggcggtcctgcagccaggtgcgctcgtcgcggtccaggatgtgggtgtattcggagccgaccttgagggtgtacgcagcgcggaggcgggacagtacctcgcgcagggtcatggtctccttgccgccgaagccaccgacgttgaaggtacggtccagatcccagatggtcaggttgtgggtctcgatgtcgaggtcgcggtggtctggaactggcatgccaggctgaacccatgaaagtgggttggtgtcagcgatgaggtgtccacgggagcggtatgcctcaatgagctgcatgacgcgggtgttcttatcaacaccggtgtttggaacgtcctgtgcccaacgcattggggtgtaaggaacgttcattgcgtcgaagatctcatcccagaaggaatcatcggtgagcaggcgagacatggtgcgcaggaattcaccggacacagcaccctggatcacgcggtgatcgtaggtggaggtgatggtgacaagtttgccaacgccgagctctgcaaggcggtcttctgaagcgccctggaactctgctgggtaatccatggaaccgacaccgatgatggtgccctggcccttggttagacgtggaacagagtggcgggtaccgatgccacctgggttggtcaaggaaacggtaacgccctggtagtcatccatggtgagcttgcccttgcgggagcgtgccacgatgtcttcgtaggctgcgaggaactcggagaagttcatcttctcggtttccttgatggctgctacgacaagtgcgcgggagccgtccttctgaggaaggtcgatagcaaggcccaggttgatgtgctcaggcacgatcagggttggcttgccgtcgatgacgtcgtaggagttgttcatgtccgggtgagccatgactgccttcaccatggcgtagccaatgatgtgggtgaaggagatcttgccaccgcgggtgcgcttgagctgatcgttgaccatcgcgcggttttcgaacatgaggcgagctggcatatcgcgaaccgaggttgcggttgggatttccagggagatatccatgttcttcgcgatggacttgaaaatacccctgattggggtttgtcctggctccggaagcttaggttgctgtggcactgaggactccttggccttaggggcggtcttgtcggccggcttggtttctacgcgcggtgctgccttggctgcaggggcagcctttggtgctggtttcgcagactccttgggcgctgaaggctgtgcttctgttgtagcgggggtagtatttggtcccccctgcgcctcaaagagttctctccattccttgtccacggacttggggtccttctggaactgctggaacatctcgtctaccagccacgcattctggccgaaagtactagcgctgctcacggcaggtactcgcctcttttccttgcttcttgagggtttattgagctttgttttatccactgtaacgttggtcgttggctgattatgcctaagccccagttgtagcattaatttgttgacagttctcctaaaaataacgtgtcaggccattaaatgccacatgcgggcgtaggtgccgttagcagacaacaacgcgtcgtgagatccgtcctcaatgatacgtccttgttcaacaacaagaatacggtcggcccttttagcggttgccaagcggtgcgcgacgatgatgctggtgcgtcccttagtgactcgatcggaggcgttgaggataacggcttcggtggcggggtcgagggtggaggtggcttcgtcgagaagcatgatggaaggctcgataagttcggcgcgcgccagcgcgatcagttggcgctgtccggatgacaggttgcgcccgcgttcaccgacttgatggttgaaaccatcagggatggcggcgatggcgtttaaggctccgacgcggcgtgctgccgcttcgattttgcttgtcgacgcctccctgcatccgtagccaatgttgtcggcgatgcttccactaaacaagtgtgcttcttgtggcacggtaccgattgtgcggcgccaatcagcggtggggaagtccttgatatcgatctcgccagctttcacggcaccttcattggggtcgtagaggcgggaaaggagtttcaccacggtggattttccagcgccggttggtcccaccacagcgacggtggttcccggttcgatctggacggtgacgttgtctaggatcggatcgtctgaatagccgaaggtgacgtcgtcaagcaataaaggctgcgtggcagcctgcctagcgtgcctgttggtgcccagatctgggacgctgggctgcgttgcgagcagttcggtgatgcgacggaagccgacggcggcttgttggtaggagtcgaagatttggcttagttgttggatggggccgaacatcaggcccatgtacagcacgaatgccacgagtacgccggtggagatgtcgccgcgcgttacttgcagtgcgccgaaaccgaggacgagtgcctgggcgatttcagagagcgcgccaaggccggggaagtagatggcgatggccgtctgggatttcacacgcaggcgtcggaattcctctgcttcgcccgcataattgtcaaagacttggtcttccatgcggtgcatctgcgcggtgcgtaaaccggcgatggactcgtggaataccgcgttgacctggctggcttgctcgcgtgaagcggtgtacagcctggagctgatgcgtcggaaaatgagagtgagcacgatgatgatcggcaccacggacagcgcaacgagtgctagttgtgcgtcggtgatggcgagcatggtgaccacaccgatgagcgtgcccacagagacaactgtttgcgccagacctgattggaggaaggacgagaggttgtcgatgtcggtggtcatgcgcgtcatgatgcggccggacatggtgcgttcgaaatagctcatggacaggcgcaatagatgcacaaatgagcgcagacgcaagccgtaaagcagccgttcaccggtgcgtgccgtgataatcgtgttgatcgcggcggcggcccaggacagaaggactactacgctgcctgcgatggcgatccaccacaacgtggaggtgctttgtgcttgcacaccgttgtcgatggctgcgcgcatcagtgttggaaatgctagatcggcggctacgcccaccagcaacaacgcgatgaccgcgacgacgagccaacggacctgcttgaataaactgagcaatttgaaaccggaggtactggtgcgtagcctcccggcatcaactcgtgtttcttccgttgctgctggcagcgcctcaatctgggcgagcagctcaggggttgctggcatggacatgccacggcctcgaccaggggcaggcgcaagaatcttgtactgcttttctgtggagacctccggccacaattgctcttggctgggtagtgaaccgttgtcgagggtgaattccggatcgtgagaatcctggaaatcaagagccatcagatgcgagaaacgagcgtgatcacgcatctcactcaacggtcccagtgctgttacccgtccatcttcgaccagaccaacccgatcgccgagctccaaagtggagtggcggtgcgcgatgatcaaaatggtgacatcgtgcagttcttcgcgcaaggcctggaaaatgcggtcctcagtggaggcatcaatggcagaggtggcatcatcaagcaccaacactttgggatgcgccaggaaagcccgtgcgagggcgatgcgttggcgttgaccaccagaaagcgtcaggccgcgttcgccaatgacttcctcgtatttgtttggaaggcgatcgataaaatcatgagcctgggcaagcctggctgcgtgttcgatctgctcatcactgacatccaaacccatcgagatgttctcgcggatggaggaggagtacaagaacggctcatcaaaaaccgcgatgagattcctgcggatatcgctgtgggtgaggtcgtcgaagcgagtgcgatggccgttgctatcaaaggcgatgtggccgctgtctggttgataaaagtttccagcaagctgcacagccatggtcttgcctgaacctggagggcccaccaacacaacggtttcaccggcctgaacacccagctcaaaaccgttgagaatcccacggaaatctacgttgttgaacgacagacccaggggagtgtcgggaagtgacagggggtgtgcaggatcggtgcgttcaggctgaagatcaatgacttcaaagatgcgctccacagaagacagcgccaactgcacgcgcatgagcatgcccgacagggacctagccaccgccgacaagctagtgagataggaagaaaacgccacaaacgtgcccaccgtgatgtgaccagtcatggccaaatagccaccgccaacaatgttgaccaccaaagcaagctgcggaagctgctcaaccatggggatgaactttgccgtcagacgtgcagtgcgcatgcgctgggcaaataactcacgtgcggtgagatccaatttgtcggtctcgcggtcttcctgcgcaaatgccttgaccacgcggatacccgtgacagtttcttccacatgagtggtcagatccgcagccttttgctgggccgaccacgtggacgcaaaaagcgcttttcgcgaataggccacggcccacaacagcaaaggcaccaacactgcagcgatgatggtcagcggcggggaaatagccagcatgatcaccaaagtgagcacaagcttgaccacatttccgatcaacatcggcaacatcgccacaaggctttgcaccatgttgatatccgaaatggaccgactgactacttggcctgtgcgaatagagtcctgacctggcccatcgaggttctgcaatgagcgcatcgttttaagccggacatcatgctgtacccccatgctgagcttgcctgcggtgtatcgccgtccaaattgactggcatagcgaagcaacgcgagaagcacgataagggcaatgacgctggtcaacacgcttaatccactcggagtgaaccggtccagcaggtcagtggttaaagtatctccggtatttccgagcgcgatatcgatggcgccaccggtcaaaagaggaagtgtaagttcaaacaacgttgcagctaaagcgctgattacggtgaatgaggtgagccaaggtcgctgccacgccacggaaataagttggcggatgcgttgtggcttttcaggtgctttcttaggggctaattgtgctttttgggattgctcagttttcatgcgtgagcctttcagtatttttgagcctgttgggggagtaatcctttctgttggaagggtcttgagtacttaaaaatgggtggggagaggaccaagagagtcgtatgcgtttccgacagtcctcttggcaattttgcggttggccatcgtgcccagcaccgcaccgataccaaacggcagaattttgccaatcaatgccgaacggaaacgcttgcttacttccttcactgcgtagcgcatcagtcggccgttgacttccatcaagccaccgatattaaaccgggaaatcgcaatgcccggcgcgtggtttttcttggataaatcaccgacgcctgcgtcaacaatggctttgcctgcggtgcccagcagaaccaccaaaatcaaaccacgtcggcgttcaggatggcggatgtcgatgccacgcaggtgcgcggatgccatggtgtaaaacgcagcagcatccaaaaacaccaacgattcagcaccaacggcaagagcacccgtgacaaagccaatgcctggcacggccgcagccatgcccacaccagcgccagagccggtggcaaggcgcataaaatgcttgtcgacgagtacctgcagctgcgccggtgttttctcaggattgtgcttccgaagccaagaaatgtatccctcgatggcacctgtttgcatatgagctgccttgtccagggcacggattaggtactttccgctgaacccggcgttgtcttctaaaacagcggggtcggaatgtactgcatccgtgatgatggcgttgtgttcagccatgtggtgcctcctaaaaataggggagagaaatttacttggagaactcctccgcagcaatgatctggtcgttggttggaagaactccggtgtagaggtggaactgctctgctgcctgaagagcggcaacttctccgccgtcgatggtttgcttacccttttccttggccaacttaatcagtggggtctcgacggggaatgctacgcagtcaaagattacgtcggctcggtctacttcatcctcaccaaaagatacaacgtcttggtcaggtccattcattcccattggggttacattaaccaaaatttttgcgtcttccggaacagttgcggagtattcccaaccgtaacgggaagctagcgcagaaccggtggtgtggttgcgggcaacgacggtgccactcagaccatactcagcaagagctgcaacaacagcattggccatgccgccggatcccttgatagctactcgtgcattggggttcacgcggtgttcttcaaggaggtggtacaccgcagtgtagtcggtgttgtatccgacaaggtgtccgtcattgttgacgatggtgttaacagaacgtatgcgctctgcggaaggatgcaactcatcgatgagtgggatgacatcgctcttgtatggcatggagacacctgcgccgcgaatgttcagaccacggatacctgcgactgcagcggtgatatctgctggggcaacagccttgtacaggtagttcaatccaagttcagcgtaaagccagttgtggaaacgaacaccatggttggatggacgagcagcgagagagatgcacagggttgtttccctgtcgacgtagttgaccatgacagtgattttatactcatgcggagcaaaggaagagcaaatgcctgattgtgtgggatatggcttgattattggtggaagttttcgggaaattcctgcccatttgtgtgcggttggtttttgaaaatcctgtacatgtccggatagctgtggatttgccgagccgacagattggtgacgatccttgcgcgcataactgcatattcatcaaagcgttgccggtcacctgcttcgtgcctagcctgggaggcatgaatagttcgacgtggacacctcggtactcaccgcatatggctaacagtgcagcgggttcggtgttggcggatgagatggtggttcccacctcaacagggtttgttaaaggcgtcaaaggaccagggcttaaaacctggaggggaattccctacggccgaaacactggcggaaaatatcgcttccgggcaccccggcccgccaagaaatgggacggcgtgcgcgattgctcaatgttcggtgaagtagcttctcagccaacgtactcctggacagataagattcgcggttcagaagactgccttaacctcgatgtcgtgcggcctgattccgaagaaaagcttcctgttgtggtgtatctccacggcggttccttcatcatgggctcatcaagcgaaaaagcgctgcgcggatataacctcgtcacaaacatgaatgtggtctacgtgtccgttaatttccgcctcggcgctttgggctatctagatctgcgttccgtgggggaggattgcgtagccaaccccgcgctccacgatcagctcctggccctgcagtgggtcagccgtaatatcgaagcattcggtggggatcctgacaacgtcaccctcatgggcgaatccgcgggcgctgcagcagtggttgcactcatgtgtgtgcccgctgcaggaggactattccaccgcgccatcgcccaatccgcgccggtcatctctgtgcactcatctacccaagcaaaattctgggcacgtgaactgatctaccgcatggcattgcccagggaaaccaccttggatgaactgcgccaagaatccgccgatgatctagtgcgcgccgggcagtcgatgatgtggcgctccggcgaactgctccaactcaactcttgttacgggcccacggtggatggttccttgctacctgagcacccgctcaccatgtttgaacagggaagacaacaccgcattcccttcatgatcggtactaataacggagaaacttctttctccaaagccttttatttaagaagctctgcccgacgtcgctctgccttacgcatgctgtctgtgtatgatccccacaatgcagaacgcgtggttagcgcctatggcggaggcgaggcacgcacagacttttctgaactactcgctgacgcgctgttctgggcaccgtcggttagattggcgcagtcgcacgcctcccaagatgaagatacctggatgtaccgcttcgattacgccccacaatccatgcggaaacttggcctcggcgcgattcactctttcgaactcaacgctgtctttggcgatcatgaatcttctcgctccatgaaccttgcgaaaattgccggcggcatggatcatttggataaagtcaccgaacttgtccaagagcattggaagcaattcatctacttcggcaggcccggtgaagagtggaaggcttaccgcggccgcagcgataccgaaccgggccgtgctacatttgtcatcgatatcaactcccgaatcgcgtgggatccacgccaggacaaacgcacggcgtgggaaaattacgacatgctcgaatggggcacaggccgcccagatctagccaacgaacttgatttcatcgagccggaagagacagaagaagagcagcaattgaagtggcttagccttatgcagttttttggaagtagataaatgagcatctggaaacgtctgttagtgcagtacccgcgcttcgccgacaccctcacagccggccaacccatcacgctcgaggaattagcaaccccggaagtgatcttggaagctgttgccaaaggccaagaaattttcggcattgagcagccaaaacatgcagcacaactctggtttcactccctgtgcaccgcaattgtcggccccgccgtcaccgccatggtggaattcgatgtcatccccagcctcgacatacgtcgaggtcagctgcataacatcgacggttactggttcggcttcaggccggaggagatgcttgtcgacgcctccctccacctgtcgggcacccaattcggcgagagtatccgcgtggtgattgatgcattatgcgctgccacggatctgcgaccggcacccctgtgggcggttgcctcagatgcgttgggaatcgcagctagcggcgcaggtgtcgaggcctttgaagaagaacatgcccgcgaggtggcggaagccctcattgaaggaatgaatagtgtgaactcagttccatcgccgcggtttaacgacgacgattatttcattcgagctggatgctgcatgattttccactcaccacgagctgatttttgcacgtcgtgcccacagaagaggtgaaaggctaggcgcggattcgttgtggacgctaggcttgtcggcagtgtctttgggggacgtccccagcacaaaccagatggaaggtcatcagaacatgagcttttttgaggacatcgcggctggacttgatagtgacggtatcgagtcccgcgtaaacggcgacacaatgttcgttccgatcacctctgacttggaaatccagttcgtggagatcgattccctcctacctgcagcaaacgtttatatcgctgcagccaatgttgatgaagacgatgatgagttcgaggcagttctcgtttcggtggtgttctctgttgaggatgctgtcgctgctgtcgcaaagcatgttgctactgatcaggtggtgactgtgctgcgtgatctacttgaaggaactgatgaacgcatccaggatttggagtttttccaggatgcagtgaatgcaaatttggttcgtgcggaagtcggccagaattctgagcttcaggttttggtcgaggttgaagacggcgtcccaaccgcaacggtcaatttcatcgcgatcggtgagtcctttgaagatctgattgatcaggccattgaagaattgtgggaatccgacggcgacgcagttctatcggatgaagatcgccaacgcatgttcgctgatttgacctccgagttggaatttgtcactgatgaagtcctcgacttgggtaccttcactgattttgatcgacttttcgatatcctttccctcgccgatgaccaggctgaggattgggaagcacagctcgttccttttgaggacgaggaatttgatgagccggatgtttatgaccttttcgtcgatgactctgaagaagatgacgacgacctcgatgatgacgaggacgatgaggatgatgacgaagactagattttagcctttgtcgcggtgccctggattcttggaatccagggtttcgtcattttctaggctgcacttttggaatattcgaaaaggaaggaaggggaacgcaccggatcaaagtgggcgtcgacaagccagcaaaacgtcggtgccggctcatcggtgagctggtggacagtgccgctgtgcgcggtgctgagaattgcgcggatccagccttcggcgaggcgggtggatactttgaagccctctgggctggtgatgcggatggtgatgagataggcgggttcacgttgctcaccgaactcgcggatgatttggcgggcggcggggcctgcgcggtgacgtgacaaggtgagggtgaggggatcttcgccgggaagtgacggtagcgggatgctcggcgggcgccacgtgggtatggctctggccagtgatcgagggtggcgcatcatggattgaatgtcatccagggcggtggggaagacgcttttgaagtgggcggcgtagcgagttgcggagtagatggaagacattaggcggtttcggtgtttgatcatagtgggaagtgtagagcacccaagcgacattgttcgataatatgttctattattggtattaatactggtcagctagatataaaaggggcgcagggctagccttgggtgtgaaatgttaactcaaaaaatagaattagaggctaaaccaaaaatcccagaggagatctgggtgctggttgtggctgcgtttattattgcgctgggctatggcctgattgcgccgattttgccacagtttgtggtcggttttgatgtaagttttgcagctgccagtgcggtggtgtccatctttgcgggcgcccggttgttgtttgcgccgatgtcggggagtttgatcgataagatcggttcccgtcgtgtgtatctcactggtttactcaccgtggctatcaccacggggcttgttgcgttggcgcaggaatactggcagattctgctgcttcgtggcatcgcaggtattggttccaccatgtttacggtctctgccatgggcctgatcgtgaagatggcgccggtggagatccgcgggcggtgttcgtcggtatatgccagttcgttcctgtttggcaatattattggcccggttgtgggtgctgcgatgtccggtttgggcatgcggtggccgttcgcgatttatggtgcttccgttggcttagctgcacttgttgtgtggtggcggatgccgaaaaccaacgattcacttcggaaggctgatagcaatagtgtgccggcgttgcgctttgctgaggcaattaaggattctgcctaccgctcggcgttgtttagtgcttttgccaatggttggtcgaactttggtgtgcgtgtggcggttcttccactgtttgccgcagctgcatttagcaatggcggagctattgcgggttttgccatggctgcgttcgccgctggaaatgctttgtgtctgcaattcgcgggcgatctctcagatcgcattggccgtaaaccgatgattatttccgggctgatcgtcaatgcagtgttcacggcaatgatcggattcggcacagaagtgtggatcctgatcacggtatctgcgttggcaggtgctggtgcgggcttgcttaatccaagtcagcaggcggtgctcgctgatgttatagattcccgccccggcggaaaagtcttagcgaatttccaaatggcgcaggatttcggtgcgattgttggcccgattctcgtaggcatgatcgcagaacaggcaggcttccaaatcggattcatgctgtgtggtgtgatcagtttgctggctgcggtcgcatggatcttcggccgggagacgctgccaacggcgaaagtcgagcaggtataaatgacgccaattgtggagtccagggcgtggaaagctctgggcgctttaagtgttgggctgtttctcacactgcttgaccaatcgttggtggctgtcgcgctgccaaagattcaagaggatttgggtgcgagcctgaaccaagcggtgtgggtgtcagcggtttatttgctcacttttgcggtgccactgttgattactgggcgcttgggtgatcgttatggacagcgaaatatttatcttgccggcatggctgtgtttaccctcgcggcgttggcctgtgtatttgcaccaagcatcgaatggttgattgctgctcgcgcggtgcagggcctgggcggatctcttcttaatccgcagcccctgagcatcattcacaagattttcgcgcatgatcgtaggggagccgccaccggggtgtggagtgctgttgcctcatcagctggacttttcgggccagttatcggtggtgttctggtggggtggatcagctggcgtgctgtgttcttggtttatgtgccgctcggattgatctccctatttatggtggcgcgttatgtgcctaaacttcccacgggaacctcgaagatcgattggctctcgggtgcggtctcacttgttgctgtacttggtgtggttcttgccttgcagcaggggccagaacttgggtggggaacactgatttgggtgtcccttgccgttggtattgctgcagctgtgctctttatatggatgcaaacaagatccaaggcgccactgatgccgttgaggattttcaagacgcgcaacttcgcgatcggtgcattttcgatcttcagcctgggctttacggtgtattccgttaatttgcccatcatgttgtatctgcaaacggctcagggaatgtcgtcgcagttggccggtttgatgttggttccgatgggcatcatctctgtggtgatgtcaccagtaattggacgattggtggatcgcctggcaccaggaatgatctccaagatcggattcggcgcgctgattttctcgatggcgttgatggctgtctttatgatcgccaacctatcgccgtggtggctactcatcccgattattttgttcggtagctccaacgcgatgagttttgcaccgaactctgtgattgctctgcgtgatgttccgcaggatttagtgggctctgcttctggtttttacaacacctcacgccaggtgggcgctgttttgggcgccgctaccttgggcgctgtgatgcaaataggagtgggcacggtgtccttcggtgttgccatgggtgcggcaatcctggtgacactcgtgcccttaatctttgggttcctagcggtaacccaatttagatagttgctccgattttctcacgagcctgcttagcggactcaacgagaacctttagggaagcttccacttctggccatccacgggtcttcagaccacagtctgggttgacccacagctggcgaggatccacggactgcagtgcagcctcgaggagaccgtccacttcctgcgcggaaggaacgcgcggggagtggatatcccacacaccaggtccgacgccgagctcgaagccggaagatttcagagcagcgaggacctgcatgtcggaacgtgctgcttcgatggtggtgacatcggcatccaacgcgatgaccgaggagatcacttcgttgaactcggagtagcacatgtgggtgtggatttggacgtcgtcgggtgcgccggcagtcgccaggcggaaggagtccacggaccactgcaggtaggcaggcttatcgacgtctcgtagcggcaacagttcacgaatcgcaggctcatccacctggatgatcttcgcgccagcctcgatgagatcgttaatttcatcgcgcagtgccagtgcaacctggtcagcagtggtagccagcggctgatcatcgcgaacgaaggaccatgcaaggatggtgactggaccggtgagcattcccttgacatgcttctgggtcaggctctgtgcgtactggaaccacttgacagtcattggcgctgggcgggaaacgtttccgaacaacactggaggacgaacacagcgggagccgtagctttggacccagccgttggcggttgagaggaaaccgtcgagaagttcagagaagtactgaaccatgtcgttgcgctctggctcaccgtgaaccaacacatcaagaccaagttcttcctgcttggcgatgaccagatcgatttcttcgcgcattgcctcttcgtactgctccaaagtgatggattccttgcgcagacgagcgcgagcagaacgaatggatggggtctgtgggaaagaaccaatggtggtggttggcagagctggaagctccagtgacttctcctgcagcgtaacacgagtgtcgaaggatccacggctacggccagggagttcctgcgtgattggtgcggtgcgtggggaggtgcgtcgagaagcaattgctgcggacgccgcatcgaacgcagccgcgtcgatgttgccggctagggcgtcggcaagcagcttgacctcggtgatcttctccgagccgaaggcaagccagtcgcggacctcaggctcaatgttctcagcctcgagggtgtaaggaacgtgcagcagtgaacaagaggtagacactgcgattgggccgcgagctgccaggcgcttcagggaagcaagagcagcacacaggtcggtgcgccaaatgttacgaccatcaacgatgcccgcaaccagcagctcctcacccttccacgcagcaagctcagtgacgccatgggtgaccaagtcaacgccaatcgcgccaaggccgatgcccgcaagagtgttcagcgcctgatcgccagagccgaagtaagtattgacaaacacgccatcgcgcttagccaaagtggtgtaaccagcgcggacctgctccaaaacctcaggagcaacatcggtgaccaacgcaggctcatcgatctgaacccactcagtatcgaaagacttgatgaggcgctcgtagacctcaaacagtgcaggcaggtgatccaaaggattggaaccatcagtggtgcgagcaagggaaaggaaagtcagtggaccaaccagaacagggcgggcattaacgccacgaacctgctggcaacggagatcctcaatcagcgcggacgcatccaaaacgaaacgtgtatccgcagacaactccggcacgaggtagtggtagttggtatcaaaccacttggtcattgcctgtgcaggcagggtctcagtaccgcgagcagcgccaaagtagcggtcaatccacagtgggagaccatcgttttcatgatcagcgatgtcatcaaaacgctccggcagcacacccaaaatagcggcggtatcgagcattgcgtcgtagtaggaacgtcctgcaaacggaacggaatccaatccagacaaagaatccgatgcagtgttgaccaattggcgggcggtctgcgcaagttcgcgaccttcaattgatccattccagtagccttcgagcgcgaacttcagttcacgcttcgctccgatgcgaggaagaccagcgacagtggaagaaaagttggaagtcatgtgagttaaagactttctgcttgagccgaacgtgcggatcccggctaggacgcacggcaatcttctgacgatgtttcaaggttcgcgaaatcaccgggtggcagaaagctgccccgggggtttcctcgcctttttgtaatcgaggtcgtcccacttaacgcttaaaatttccattcagaaagctttggcgttcctcatcatccggggctccagggagaggattaaaagtgaaccgattgcgttttcaaccaaaccctagactgctcggtctgtcaagaagttccggggatttaaattcatggtgccgttttgggctcctgttgtctgcgtcgggtggggaagtggcgtaaaggtgtgcaacctcatagtcaagttgacggaaaaggggagatcgcattttacccccgcagattttggggaacctgttttgaactggggttttgcaaaatgcaacgcggtgacgtgtggttacacccgttgatggttgggtggtgggtcacagtttagaaaaagtgacttcaaatcacgtcgaaaagaaattgaaagtacttaagaaacatgtcacgctaggagacgtgataatcattgcaagcgttgttttcctcctcgttggcgcaatgttggcgaatgctgccgctgcgctctttagtgccagcgagccattcggacgaatttcctacctcattggcctacctaacgaagacgacttcgtgccgtactcactacggttcgtggcctttttcccactgatgctctccgcatcgatggcagcatccttcttcggggtgtgggcagtactaatcattcctttcggttacttcccatcactgatgatggttcataagcacaacaagcaggtacagcgaacctgggattccgtcaccgttgctgacttctacgaggattccacccctctggtctaatttcgatttctaaatgtcatattggccgctttccactcatgtttttgagcaggaggcggctttttgatgtcttaggggtgggtttctggggttttacctagtttttggaagggtgaaatctctatcgctgggtggattggtaggaaatgtcgtgatgcgagtggtcttgggtgcgcgactccatcaaaaccagacaagcgtgacaacggagctcaattttctgagtttctgtcacgcctgtctggtttgcctcgaaaaggctgatttcacgaccaagatccccaaaagttcgacctctcagaatcgcttataagggcctttcgtggccccgtccatacaaacgcacattcggaaaaatgaagcccttaaatcgccatacagcacctctctcgaaatgcgcaaccacggcaattcagccaatctgcaataaaaaagtaaaacttatttagcggcccgtgaagatccccgaaaggtcacaatgaccagccattttgcctaaaccgtgtgctggattaaataggtgttaaatattaaaaactagcgagccctgaattaatctgttaaggtcctacatggacttcagttagttgaggctgaagtttttgacatgtatgtctcgtccgagttcgccgccatccaggtggtgcaccgaggtggattcatggtgaatccttaatcgagtgaggccccagtccagggaagcccgccgcattaagtgagttcctgatggcttcgggtggaggatgtagaactttttgtacatggtctgtggcacgcattgtttcgtttgccctgccatgttggtgttttaagtgaaggccgccttttgcggaatgggtataggaggcattcatggagatggttatgaagaataagcgcgttgcgattattggtgcaggtccgagtggtatcgctcagttgagggcgtttgagtctgctgaaaagcaggggcatgagatccctgagctggtgtgttttgaaaagcaggatacctggggtgggcagtggaattactcttggcgcacgggaacagactcttatggtgagcctgtgcactcaagtatgtaccgaaacctgtggtcaaacggtccgaaggaagttctcgaatttgctgagtacagcttcgatgagcacttcggaaagccaatttcttcttaccctccacgtgaagtgttgtgggattacattgcaggtcgtgcaaagaagtcgaacgttgagaagtacatcaagttcgcgcatgttgttcgctgggtgagttttgatgaggccaccaagctgttcaccgtgacggtggagaacctccgcaccggtgagaccagcagtgatacttatgacaacgtgattgttggcgctggacacttcagcttcccgaacgtccctcactttgatggtgtggagactttcccaggtcagatcatgcatgctcacgagttccgtggtgcagaggctgttgctgacaaggatattttgctgattggtgcaagttattctgcggaagatatcggtacccaggcgtacaagatgggtgctcgttcggtgactttctcttaccgctcaaacccaatggggtatgagtggcctgaagagatgactgagcttcctttggttgagcgtttcgacggctccgaggttcactttgtcaatggtgaaaagcgcaaggtcgacatcgtggtgttctgtactggttacttacaccattacccatttatgccgtctgagctgactttaagctcaccaaacaacctgtacccggatacgctttatcgtggcgtggtgtccgaggctaataaccagctgttctggttgggtgctcaggatcagtggctgacgttcaacatgtttgatgctcaggcttggtatgttcgcgatgtcattttgggccgcgtggctcttccttccaaggaagcgcagcgcaatcatatggataagtggctgtcacgtttcgaaggcttgaagtctgagaatgatcagattgatttccagtgcgattacgtcgaggatcttatcgatcagaccgattatccttcgtttgatctgaaggaagtcgcgaatatcttgaagggctgggtgaagtcgaaggaggaggatatcctcaactaccgtgattacacctatacttccgtgatgacgggcaccacctctgttgaacaccacactccgtggatgattgagttggatgattctttggagcgttacctcagtgagccacaggaagatgaagctcgtcaggtttaccgtggcaagaaagtccgcgataaagcctaaggaaaaggcctaagcagcccttgcataaaatagcggtgtgctgtcagaattagcgcatggcaatcatagcgagtgttgtgttcctcattgcggggactattctcgcagccatcgccaccgcccgttggagcatgctcgaaccctatggattgattccgtatttcataggtcacgatattgatttcgagcaaaaaggccagttcttggtctattttctccgcgcggcgggctttttcgttttgattgtcgcagcggcgtttgcgcagcctttctttgggctgtgggcactgttgcttctggtggtgggtgggtttccttcggggatgatggtgcgtcaacacaatcgtcgggtgcgtgcgatgtggcggccccgcgagacatagattaaggactactctcgaacacatgcctcaaatccctgcccagaattttgatgatgttgcgttgatcattgagggcggtggaacccgaaattcttatactgctgcggtgattgatcagttgatcgccaacaatattcatttcggttgggtcggaggagtctcagcgggtgcgtcgcatacggtgaattatctttcggcggatcgtttccgcacggtgtcgagtttcgtagagtttgcggccgatcggcggtattcaggaattcagccattggtgcgcggtcggggctatttcaatgcggtggatatttatgagacctccacgcaacctgaccaggaatttcctttcgattttgacactttttcagccgaccccacgccgtttcaactctctgcggtgcgtgccgataccggcgagaccgttttttggggcagggaagacaccccggatttgagcgctctgatgaagcgggttcgcgcgtcgtcgaccatgcctggtttcatgccgatcacctacatcgacggccatccatatgtcgatggcgcggtcggggagaccggcggtttgatgctacagccggccatcgatgcgggcttcacccgctttttcgttatcgcctcccgtccgcgcgattattggcgcaaggagatcgggcgcccgggtttcatcaaagctgctttacgacgtttccccacaatcgccgacctcaccatcgcgcgtcctgcactgtataactcggtaaagcaacagatcctcgacctagagaaacaaggcagcgcctatgtgttctttgcggacaacatgaacatccagaacacggaaatcaatctgaagaaactccgtgcatctttcgatgcaggcatgcagcagacccgcaaagattggccggagatcatgagcttcctgaaccaaaccagataatgaaggtttttagtccaactgcaggtcatcgcgaaggtgttgtggccaccgcgcgacttccgctggggtagtggcaatgcgcagttgggcgtttggcatgaggcgggttagctcgattgccgtggatacggggtgtccgggatcgtcggtccagctcagaatagtggtgggggctgttattttggcgatttctttctttgaggggaggtcgctttgggcggcgcctcggtaagcccaggggaggagttcggcggaaatgtcggggactgtgtcgggggttcctacggttgctggtggttgggcgtggagtttttcggcgttgaggaaggcgtccatgccgtgggtttctaggaattctgctcgggataggtattcggaggcttgggcttttcgggattcccaggcggtgggtgggagcatgagtgtgaatccactgaagcggtcggggtttaacaccgcggctttgaggagggtggcgcaacccatggaggggccgacgccgtggacttgttcgtgggggaagtgggcgtcgagaagcattaaaaggtcacccgctagggtgtcccactgataatcggtggaggcagcgcggccggtggaggtgccgtggccgcgggcgtcgtaacgcaaaaggcgcgtgccggaaaggccacggccgaggtcgaggtcgaggaggcggtcgcgttggcgggaggaggtgaggccgtgaagttggatgacggcttggccgtgttcgtcgctgtatgaggtggagagttgcgcgccggggacggggaaggcgctgtgttgtaggggagagttcatggaaacttcctaaattattttctatcaatctatagatactaggtctattatagtgccatgagactgacacatgtagaccaattaaaccttccgtttggcacgttgagcagctatcacccttatgcatcggctccgggtgaggcggtgccggtgtcctttgatcagcaacgacatgtgggtgccggcgagcgaccgggtagttggatggcgattagtgtttctatgcctaaggcgatcagccgtgaggaattggagcgcgcgtggcttgaagtgattgaacggcacggcaccttgcgcacagtatttagcacgggaatgggtggggaagtgcagcaacaccgcattgatgtgggcccgggaaaatggattgaccacgccgttgcgcctggtgagagcattaatgaggcgttgcgggcggtgttgaatcggcagtgttcgccgtactcgaggccatcgcatagtttgtgcattattgatgcgcatccgcgtcccacggtgattattggtagtgatcattcgcatgtggatatgtggtccatgctggtgattgtgcgcgatttgttggctgcgctcgatatggaacttcccgttgagccgccgttggcgtttgaatcgcacaccgcggaactcctcgcggctccacctgcaccggagcggattcaccagcggtggcgtgaaattttggaagctggtggtggaaaaatgcctcagttcccgcttccgcttggcgatgccatctccatgcctgaacgcgttgaagtccgcgacattttcggggtcaatggcttggcgatttactcggcacgcgcccgcgcacaacaggtaagctccctggccttgactatttcagtgatggctgatgttacggcggcgctggcggaccttccgttgcgtgctgtattcccagtccatagccgtttcgatcagcgctggcacgatagtgtcgggtggtttatctccaattcggtcattgaggtgccagattccgatcctcacactgcagcccaagctgttcgcgaggctgtttctttgggaagctacccgctggctgagctgcttgaaccgtggggtggcatgccggaaacgccaggaatgtttgctatttcttggcttgacctgcgccgactcccagtgagcattgacgatattggcctccaagcccagtatgtcagcgcttcactgcgcaccgatggtgtgatgctgtggtttattttggatcgctccggcgcgcaccttcgctgtcgttatcctgactctttggtggcgcgggaaaatgtaggccgctggattgatgcgattgttgctcagatgcgcgccgaagctgggacggtgaatctgcaggccggcggggaacagctgacacttcggcatggaactcgcgccgatatttccgagatcgccccgctacttgcccgaaacgcagctgacccttgtgagctggtggatcttgaacatgcccttgacctgctgacacacgagtcttcgcatttcctggcggtggttcgaaacgctcgtggcaagataatcgcagcgatgcagttgactattgttccggagttttcccgcggtggtgcgcttcatcttcacatcgaggggccgttcattattccggaatatcgcaccaccgatttggataaaaagctgcgcgcctgggctgtggagcatgggcgtgcgcgaggggtgaaggttgaggaggtggtgggatagttggtttattggcgcctcgttgtggaaggcgatttaaggggtcaaggtgttccggagtggtccagagtgtcggttgaggttgtttgggtccttaaacgcgattctaggagggtgacattttggggcaagtggggtagatgtgaaacctgggtgtttgctgatcaaggactcaccacaaacaggcctggaaagtaaaaatcgaacagatttttgcatattccgggagctaagttgcaaaaatccaccacagaaggctggaaacctcgaatctgtggtggatattcgcacattctttcccctatgaactaagtcgacaacgaccaccaactaacatcattctggtcagaagacagcggggcaaaattacctcacatgcctcacaatcactacggttctcctagctcttttaccagggagttcatcggaggccagcatagacaagatttcagaggagcctgcagtgtcgaggtgctcggtgggttcatccaaaagcagaattggtgcatcacttagtagtacgcgggcaaggagcaggcggcggcgctgacctcccgagagactatcggcacctgaatcaaggacagtgccaagaccatcgggtaaaccttgaacccactctgacaaaccaacatgttccaggatcgatgtcatttccgcgtcggttgcttccggtgctccgagtgctaagttatctcggacagtggtggcaaaaatgtgggcatcttctggactgaacagcacggcgtttttcaactcggaaggattggtgccgtcgataagcacttggcctccacgaggttccaacagccccgcaagtgtgagcagcagggtcgttttgccagttccagagggtgcgatgatttcatgtcgtgaaccaaaggtgagatccaggttgctcgtgcctaggtcgctgtcccatccataaactagattctcggcgcgtaatacgggctggtcagaggccgtgcgaagctcaagagagacagattctggcagcgccgagatttccgcaagcctcctggtggcatctgcggcgcgggtacgagcaatcgcagcatcggggagaacagagacagcctcgaaagctgcgagtgaaagcagcaccaacacaccaaaccactgcggtgaatggcttccatctgcatacagtgacgcggaaaccatgagcacaccaatgacagtgaaaccgtgaatccacagggaactcgctgcgccaatggcagtgtctttcgcgcctgcctccagtgaagaagaataggaacgcgcagccacatccgccttggacagagcggccggcatttcaccacgaacacgaagcgccgcctggttggacagcacctgatccaaggaactcaagtaggcttcgctggattcagcgcgccgggcttcggctgttttaactccgcgagcagcaagcaggggagggataattgcagcagcaatcaatccaatcgccaggacaagtgcggttgcggggctgagaatcgcggtgaagatgatcgcgacaactccggtgagcagggcaactccggcgggaatgacggcgcggacgatgacatcggcaaccgaatcgatatccacaccaaggcggctaagcagttcgccgcggcgcatcgtcaacgcagagtttggcgacgaagccaggcgttgatatgcactcgaacgggctcggctggctgccttcaacgccaagtcatgtgaaacgattctctctatataacggaacatcgcacggctaatgcccagggctcgcacagcggtgaccgccacggtcagatccatcactggcggcatttcccaagctttggtgatcagccaggccgacaccaccgtcagggtgatggaggcgatcatcgtgacgctacctgcaacaacggcgggaattagctcgcggaaacgaagttttaccagggtgttcatttgacctccaccacttcatcggcagccgcacgcagcaaaggatcatgcgaaaccgccagtactgtggtgcctcggcgggcttcagcctgcaattgctggatcatgatcgcagcgttgtctggatccaggtgcgcggtcggctcatccaacaggagcaattgcgccccaagctcacgtttcagcgcaagccgttggcgctgcccaagcgacagttccgcataatcactgacactttccggatcaatgaccggccgctgcggcaaatatgcgcagtgctcccacaatgcgctgtccttaaattcctggcccgaggcatccttgacggaaacctctccagtgatgccttccgtcgccaagcccaacaccgctagcaaggccgtggatttgccgctgccgtttggcccccacagcaccgtcaactgcccaggctttgcggtgaacgacaaatcagcaggcctcggcccatcgcgtccatcagcgcgaagcttttcgacgctcacctccagcccgcctgcaacgtcgcggggtgtgtgggtaggcgcgtcgacaagcgaagaaacgctgagtaattttaggatctcatcggtggcaaccaggccgtcttgggcgtcgtggaagcgggtgccgacttcgcggatcggcgcgtagacctctgggatgatgatcagtacggtcaggccgatggcgagggtgagatcgcccgcgagcaggcgaaatccgatgccaaccgctaccaatgcgaccgatagtgtggccaaaaattccaacacaaagctggaaaggaacgcgattttcagcacgctcaacgtggagcttgcatgttgggaggatagtcgcgtgacctgagctgccatgtcttggtggcgcctgaatgctcgcaaggtgggcaagcctgcgatgagatcaagcagctgacctcccaaaatggctaggtcgctgaggcgttgttcggtgcgacctgcggtgagtgttcccaccagccacatgaacaccggaatgagggggagcgtgatgatcgcgatgaccatggacccaacatccagccaacccaccaccgcgagcatgaccggggtggcaatgatcgtggcggctagagctggcaaaaatccggtgaggtaaggccccaaaccatcaaggccagaggtcaaacgggtgcgccacaaggcttgatcgatggtgcggggatcgctttgtgccaggtgccgcagggttttctcccgaagatccacagtcacctgggacgatgcgcgttgcgcgaaccgatcctgtgcccacgcaagaagtccgcgcacaaccaccgtgatggcgagcgcgatgagttccattcggggcaaagaacttcccgaaacctcaatgatgcccgctgccatctggccgatgagcaagcccattgcgactgtcgcgagggttttcaacgcggtgagaacacctgcgattatcacccaacggcgggtagcgggggataggcgcaaaagccgcggatcgacggggccggcgcgcctttttgcaggagctgaagatttagtactcaatttttccaactttaagcagacactggctcggcgtgaagtcgtttgcggaacacccagtaggtccagccttggtagaggacaaccagcggtgcgatcacagcggcggtccaagtcaggatagtaaatgcgtaggcgcttgcggaggcgttccagatatccaggctcacgccatcagcaagcgttgttggcatgacgttggggaaaagcgaactaaacagcagtgcaacgacaccgatgacagcgacggaagtggacaggaagcttaatccatcgcggtctttgatcagtgcgaaagctccaccgagaaccgctgcgatgatcagcactgcgaggatccaggaccaggaacggccgtatgcgatggcagcccacaacacgaaaggtccaccagtcaccgcagcaagaagtgcgactactggagctgccttcgccgcatcggtgcgcacccgaccagcagttttcaggcggatgaatgcgagaccatgaagggcgaacagtgcggtgaacgcaagtgcacccagaatggcgaagacgttgaccatgccaggaagggctgccgcagcatcgatggtgtgatccgccttgaggggcatgccacgcaaaatattggcgaagatgaatccccacatcagcggtggagtccaagaaccaataaagatggcccggtcagaccacttttgccaacgaggatcatcgactttcttgcgccattcaaggcccaccacgcgcatgatcaacgacacaagcacgaggaacagcggcagatacattccggagaacatcgttgcgtaccactcagggaaggcagcaaacaaagcgccacctgccacgatcagccacacttcatttccgtcccagacagggccaatcgtacggatcactgtgttcctagccgctgaatctttaccgatgatgggtgccaaaattccgacgccgaagtcgaatccttcgaggagaaagtatcccgcaaacaaaaatgcgatgagaataaaccaaaaggtattgagatccatggttattccttttcacctgtggttggggcagcggcagtaaattgcagcggtgtcatgggcatatctgaaccaatcggggttgccggtccagtctttgcctccacggatggagcgccttcctctggtggtccgatcagaactgcgcggcgaatcagccacacccacaccacgaacaaaatgagatagagaatcgtgaagccaatgagagtcagccagacttgccatggcgcatgatcagatacacccatatcaacagtcatccggatcatctctgttcgggcatcgccggcagattcagggttcgggtgcaccacccaaggctggcggcccatctcggtgaagatccaaccagcagagttggccaagaatgggaacgggatagcaatgaggctgccgatctggaacagacgagcaatctttccagttggtgtgcgcttcttacgcagcaacagccacgcaatcgcagcgatagccaaagaaccaagcatcaggccgatcattgcgcggaatgaccagtaggtgacaaacaagttaggggagtagttgccaggaccgtatgcttgctccgctgcagcttggagctggtttacaccctgcaaagtcacaccggtgaattttccttcagccaagaatggaagcacaaacggaacatcgatcaggtgggttaccgtatcgcagttgttgtgcgtaccaattgtcagaatggagaagtttggatctgtggcggtttcacacaaggattccgccgacgccatcttcattggctgctgcacgaacatgagcttcgcctggatatcgccagtgatgaacagcgccacggaagagacaactgtggtccaccaaccaacccacaacgcgggcctgtgcatcgaatgcttcgactcgatttccgactcagccttcttggcctgacggtgcgcacgaataatccaccaacccgaaattccgagaacgaaagttccagctgttaaaaaaccaccggcaacagcatgcgggaacgcagccagcgcggtggagtttgtgagaagagcccaaaaatcagtaagctccgcacgaccagtctcagggttatactcagcacccaccggatgctgcataaacgagttggccacgatgatgaaataggcagaaatattcgtcgcaatagcaacgatccaaatggatgcagtgtgcaaccaaccaggaatcttcccccatccgaaaatccacagtcccaggaatacagactcaaggaagaacgcgataagaccctccaaagccagcggtccgccgaaaacatcaccgacgaaacgcgaatattccgaccagttcataccgaactggaactcctgcacaatgcccgttgctacaccaaccgcgaagttgatgagcagcacagtgccaaaaaatcttgtggcccgataccagtgctctttgccggtaacttgccaaaacgtttgcatgattgcgaccagcggcgctaagccaatggtcagtgggacaaaaatgaagtgatagacggtggtaattccgaattgccaccgtgcgatgtcgacgacatccacgctaggtacacttcctcttccattgcaggttgacaggaacagccttattaagccaggaaaccgattgtatttatcgatacaaaacgaagaaccaataagagcttcttaaaggttgtcgttgaagtttattcctaagttcccgctcacagcttaactttataaaggttaaccccgattgtggtcaaccttttcctgtcaatgactgatttcgctcccccttgttgacaagtcaccaaaaagcgtcgaaaagattttgcttttcgacgcttggttgcggtggttactccgttacggcgagatttgtgctcaggtactcaaacaggctttgttcgacgggtgtgtcgaactgtagatccattgtgaccaccggttgcacaactcctttgtttccgggcatcgatgactgtttgctgttttctgaatgcgcttgaccaaggtagaagaaatcaaggccttcggcatcgtccttcttcacaaaaacatgaagatccacagcattcgcagcgatgggcttgatctcattagacgtgatctttcggttgccgcgggaataccaatgaagggtattcggatcgacgagttcatcctggtaacgagtactttcggatacatcatcagccttgtgataggtcacaaagattgggcaagtagatgtgtaactgtccactttgtatccataaatcgtgctctcgttgtttcgttcccaattgagaattcggcagacatctcgtcgggagtatctctcgccaacaacgaggtttccttgccaaaatccattgtttctggcgataaacaaaccagtgtcgatgatgtcttggacgtgaaacttaaaattctgagcagcctcatctcggtccgtcacttctaggctttcgtcgagggcacgtcggaactcgggagtaaaagagtaggtgcggttttgaacagagaggatcggatgttcgccaaacttcttgcggtttggtcccgtatagaattcttggctcaaaatcctttcaaccgagttgattgtttgctcatctgaactagtcgattgggcctgcaagagcttacggaattcttcagtagaagtttcaggctgtttcattagttcctggatcagcaacagctcatgaggtcgcttgccgttaagaagctctccggtaaggaaatccagaaagtacttctccgattcgctgggagcgtgatcgacaaacttcactgaactgagcagcgaccagtagttgccagaatgcgtggcaaggataaacggatcaacagtattgaagcgagcgaagtctaacagtgctggcacatgattgagtcgatcttgaagctgaacaatatcctgcttgaattgtgcttttgagtccaacttcgcagccttcaacgcagcaaaaattctctcctgcgcgatgggatcaaagttaacacttgaaacacctgagattgttccatcaatatcgctctcaatcaggcggcgtctgatgctgttcttattgcgagaattatcgccaaacaatgcgatgggaatgagatagttgttcgcgtagttgccaatgaaatcaataacgcgcagatggtctttgccagcagcttttcggagtccacgcccgagctgctgcgtaaacacaatgcttgattgagtactacgaatcattacgatttgattcaccgaaggaatatcaatgccttcattgaagatgtcaaccgtcaagatgtagtccaggtcgccggactccagctcagctacaacctcttcgcggtagggaattgagtccttcgcagagagcgccttggttttaagcaagctgccattaaacaacgactggtcgagaagttttgacagctcctcagcctcttcagtcttggaacagaagatcagtccacgaacattttctggatgaccataagttttgagggcctccagaatgtgatggactctctcttcgctcaccaaggcacttagtttggaggtatcagtcaccgttgtttcagaatcaagcgtgaagtctgtgacaccgtaatagtgaaacggtacgagcatgttggattctaaagcagcttgaagtcggatctcatatggcacgttgaaatcgaacaactcataaatattgaatccatcagttcgctctggggtagcagtcaggcccaataaaaactgtggctgcagatgattgagcaatgccaaataggattcggcaccggcgcgatggacttcatcgacgatgactaaatcaaagtcagtaggggagatctgggaaagtgtagcttcctttgtcagcgtttggatggtgccaaacacaaacggcttatctagctccttggtcgagccagacatttttccgaaatcaacagcgggacgttcaagaactttgatgaactcggatcgcgccttatccagaatttgttcgcggtgcacgacaaacaaaactcgttcaggcttgagcattcttgtagctagagcagccaggatagtcttgccagttcctgtcgcagaaataatgacaccacgtttctctcccttctccgtcaaagaaagtagagcgtcgagggcctcttcctgcatgacgtttggaacaattgttccggcgttactttgatcctcgagaggaatattctgagacaccaaacgctcaggtacacgtctggttgcctcatactctgagatccattcaggcgtcagtggcgtggatcgttcaatttggcgattaatcgcatcatcaagttgaaaagcaatgtcgccattcttgctggcagagaacttcagattccattcccggtttaccaacagagcattatctgtgaggttggaactacccactactgcggtgattcccacgtcgtgatggaaaacgtagcccttggagtggaaaccatcgccttgatgtatgaggacttccacgttctccaaagtaagaagctcacgaaacatcgttggatcattgaaatccaggtagcgggacgtgataattcgtcctttacccttgaagtccaacaatgcctgtttcaacaacgcgataccgcgactggaaataaaagcgactgaaaatgtaaaagactgtgcggtacgaagctctaacttgatcgcctgcaacatggtgtgcggatcctcattagaaatcaatgaaggattcagcagttgttgcgaagcagtggtcttatcgaggaatccaaaatgggtatcgcgaccaagctttgaatcgaatgggctcattaagcaagctgctcgacgagaagtttcaccgcaggaatatcagcaggtgcccactccaaagattccaattcgtgtggtgccacccagcggatctcagcatgctcggtcaattgaggctctgcatcatttagtgtgcagaagtaggtggaaagcacgacgattccaaagtcgtactcgtgctctgtagtggtgaggtgttcgcctacggtggcgtcgcaaagcaattcttctttgagctctcgtgcaagtgaagcttctggagtttcgccctgctcgatctttcctcccggaaactcccaatatccgggaagtgacatctctggaccacgttgtgctgcaaggatacggttttccttgactaggacggcgccggttacattgatgcgtttcttcacgattctcctcagaactactggtcagaaacccaatgctaacagtaatgaagtgcccctttgtgttgcaccccgcaggggtagattgattttctgttgccttcataagctaaagttctaatttcctaaattggtaaagatcggaactcaaaaatgtcgcttcgaaagctcacaagcttaattggcatactggctgttgttggcctagtggcgtttatccttttcaacttcgtgaaaacaaacgacgaaacatcgaatgtctctcagagcgagtcaactgcagagacagtcagcgaaacaaatggcgtgctctccgacggcgcagaaaacatcgcttctcaatctgatgagagtaaatcgggtgtagagattattgattctggatttgggcagagctcaaattcggcgatggcaattgttattgccaaaacttctggtggaagcctcgcaggggaatttgttacggcgacggtgaatttcctcgatgaaagtggcgccgttgtagcgactgaagatcaagtagaaacactcagttgggaagaccaggaattggtattgccagtatctcactacaaggaggattcaagccgcccagaaattacaagcattgaggcttttctttcagtaacggattacggttcaggacaaccagatgaaactgcattgccggtgttggaaaccaccgatatttccaacccatacgctggtagttacaatgcctcatttgcgttgaaaaatgactcctcagatgattttaagaacctgagagttggtattgtttgctacaacgagcaaactgacatcattggtggtggtttcaaatttccgaacctggttccagcgggtgggagtattcgaatggacgctagtgtgacggtctccgaaatgccagcttcttgtaaggcatatttaaatcactaatagattcttaaaaggcagcatctcctccatattggaaaagatgctgcctttttcgtgcgagtctagattaatcgcgtcgcggatctagctcttcataatcgatcggagcgatcgcctttggtcggcctgtggcgtagtaaaggattgtcatcaggacaaggaatccaacgccgacggcgagtggcaggtggtagttgtcgtaccagaccatgatgccgaaggtgaaggcgataaataggatcgcgaagtattgtccgaaggggtagaaggggacagggaacttcagggacttgacctcgtcggcaggcatgtttcggcgggatcccacctgtgcgagcaggatcatcagccagacgtaaactgtggcgaaggttgctagggaagcgacgatctcgaagacgcgctcgggaagcactgcgttgaggattactcccacgatcaagacgatgatcatgatggtggtggtcatgactggaacgccgttcttggcgatcttgcccatggcctttggtgcgaggttttccttcgcaagaccagtgagaacgcggccagcgccgaagaggtcagcgttgatggcagacagtgcagcggtgatgaccacggcgttgaggagaccagcagcccagttgacgccgagggtgtcgaagatctggacgaatggggattcttcgccggtgatggaaggccaaggattaagggcaaggatcaccaggatggcacccacatagaagaggaggatgcgtactgggacagtattaacagccttggggatggacttctcaggatcttcagcttcagagcctgcaacaccgatgatttcggtgccaccgaatgcgaagagaacaaggatgaaggctgcgatcatgccttcaacaccgttggggaagaatccgccgtgctcccagaggttggatacgccggcaacttcagcgttggcgccgagaccgaatgcgaggatggctgcgccgccgacgatcatggcgacaactgcggtgaccttaatgatggtgaagatgaactcgagctcaccgaaccaacgcactgatgcgaggtttgcgccaccgacaataagaagggtggctaccacccaagtccattgtggggtgccggggaaccagaagttcatatagatgccgatggctgtgaggtcagccaggcagacgatgagcatctcaaacgcgaacatccagccggtgatgtagcctgcccatccgccaaggtgtgcgcgggtgtagaccgcgaaggaaccacggactgggtgatgcacagccatctcgccgagtgcgcgcagcatgaagtacacgacggcgccaccgagaaggtagaccaagagtacagatggaccagctgcttggattgcgccagcggaaccgtagaacaagccggtgccgatcgcggaacccagcgcgatgaagtgaatgtgtcgagcccgcaatcctttaaaagatcgggttggggcaggggaggcattcatcgagatgctgacctcgtttcgggtgaatagcggacattttttgacgcagatcaccttactctgaaggataaggattcttagtgtcggtgcacttttactgatgtttcactgtggaggtcaacgactcaaagtcgagaattggtggcgcgtgtcactggaattgacgcgtgaatggggtggaagtggacgtcgaaaagcatttttgagacgtttatgtgagcaatgtcccattttccctgctcacctgtatgggcacccgcggcggaagtggaattgcatatggagttttgatgatatttagcgtaacttaaaggaacaatgagtaataccgagaacgtcaacggcgacgtagaacagccgaataacgtcatttcgtcggaatctcaggaaaccccgcagggtgactcagcatcagctgacttcgctctcgaaaccccaaccaacactgttgaagatgcaccagcatctgagggtagcgaagagatcaccagggttgcggatacttctgaggacgccgactctgcagatgcagacaacgcgagcaatgtaatcaatgagaatgaggactcctcggaaggtgctaaccagccttcaaacgagtcatcctctacggaagccaaatccggcttcgatgcactcggactgccagagcgtgttcttgacgctgtgcgcaaggtgggttacgaaactccttccccaattcaggcacaaaccatcccaatcctcatggagggccaggatgttgttggtctagcacagaccggtaccggtaagactgcagctttcgcgctgccaatccttgcccgtattgacaagtccgtgcgcagcccacaggcacttgtgcttgcccctacccgtgagctggcacttcaggttgctgactccttccaatccttcgctgaccacgtcggtggcctgaacgttctgccaatctatggtggacaggcttacggcattcagctctctggcctgcgtcgtggcgctcacatcgtcgtgggtaccccaggccgaatcatcgatcacctcgaaaagggctccctggatatctccggactgcgcttcctcgtgctcgatgaagcagacgagatgctgaacatgggcttccaggaagatgtcgagcgcatcctcgaggacaccccagacgagaagcaggttgcactattctccgcaacgatgccaaacggcattcgtcgcctgtccaagcagtacctgaacaaccctgctgaaatcaccgttaagtccgagaccaggactaacaccaacatcacccagcgcttcctcaacgttgcacaccgcaacaagatggatgcactgacccgtattctcgaggtcaccgagtttgaagcaatgatcatgttcgtgcgcaccaagcacgaaactgaagaagttgctgaaaagctccgtgcacgcggattctccgcagcagccatcaacggcgacattgctcaggcacagcgtgagcgcaccgtcgaccagctgaaggacggccgcctggacatcctcgttgcaaccgacgttgcagcccgtggtcttgacgttgagcgcatctcccacgtgcttaacttcgacattccaaacgacaccgagtcctacgttcaccgcatcggccgcaccggccgtgcaggacgtaccggcgaggcaatcctgttcgtgaccccacgtgagcgtcgtatgcttcgctccatcgagcgcgcaaccaacgcaccactgcacgaaatggaactgccaaccgtcgatcaggtcaacgacttccgcaaggtcaagttcgctgactccatcaccaagtccctcgaggacaagcagatggacctgttccgcaccctggtcaaggaatactcccaggccaacgacgttcctctagaggacatcgcagcggcactggcaacccaggcacagtccggcgacttcctgctcaaggagctcccaccagagcgccgtgagcgcaacgaccgccgtcgtgaccgtgacttcgacgaccgtggtggacgtggacgcgaccgtgaccgtggcgaccgcggagatcgtggctcacgcttcgaccgcgacgacgagaacctggcaacctaccgcctcgcagtgggcaagcgccagcacatccgcccaggcgcaatcgttggtgcacttgccaacgaaggtggcctgaactccaaggacttcggccgcatcaccatcgcagccgaccacaccctggttgaactgccaaaggatctcccacagagcgttcttgacaacctgcgcgacacccgcatctccggccagctcatcaacatagaacgcgactccggtggacgcccaccacgccgcttcgagcgcgatgaccgtggcggacgcggcggattccgcggcgaccgtgatgaccgcggtggacgtggacgtgaccgtgacgatcgtggaagccgtggaggtttccgcggtggacgtgaccgtgatgatcgtggcggacgcggtggattccgcggacgcgacgaccgcggagaccgtggtggccgtggcggttaccgtggcggacgcgactaagagttcgttttagcttcagctcaggttttcgcctgagtctggtgcttagctagaaaaatccgttgctctctctttactgagagggcaacggattttttctgttttcttaggctttggttcttgggggatcttgggggaggaattctaggaacttagagaagtaaatgatggtgcttcgaccgcagcaccatcgttaagattctgaccaaagaagagagcattgcgttgctctctagtcagagtgcgaggtattgaactcggcttattgccgaagtttatttgaggcccgatcactactgcggtttgactggggatatttcggggagtggacgcgaagcgatctcccgggcttctgctgcttgaacacccaccatccggagcatcgcggctgcgaaaatctgatctttgtcatcgttggaatcttgatctgcagaaagcgccatttggatcgctgcgatgagtgaaccaaaagtgcatgtggttgctaggtccagatcttcgatggtgaatcggccagtttctaaaccatgaagtagatctcggcgtgcgcggggtcctaggatgcgcatgagtacgggatgagcagcacccatttgtatgaaaaatccgccccaaatccgatcttctaacgagtgccgtactagatgtcgaagcgaccctgcaaatacttcagccggatcgtctaatttggttagcacctggtcgagggcaattcccacggattcaaaggcatcttctgcgacagcttggagtagttgttcacggtctgggaagtagttgtagaaggttcccgttccgatgtttgcgccttcggtgatttcagctattcctacattgtcgacaccccgttctgccatgagtgtgcgagcggaagtgatcaggcgcgcgcgggtttgttcgcgtttttgtgcacggcggccagttggtacctggttgtcggtttgtgctgttgaagcgtccttgtgctgcgaaggcgtgggcatagggaaaaccttagctgatctgcggtgacttaaatataagggggtggaatgggggtattgtaaaatctgaacccttgttcatttatgaatcatgattcagaatgtgatctagataatgttgttcagttcactattcaagaagggttagatcccatgtcacccaataacttcgataccgatgtctgcatcgtcggtggaggtcctaccggaacgctccttgcagtactgctcggccaaaaaggtcaccgcgtcaccatcctggaaaagtggccaacattctacgaacgacctcgtgcagtcacctttgaccacgaaatcgcacggatccttggatacattggcattgattctgaaaacgacgaagccatcgattaccactccgacagctacgactggaagaacgcagcgggggagacgcttttggaagtcgattggacctccatgacagattccggatggcgcacccgatactggttctaccagccagaacttgaaaagcgtctgcgcgatctggccctgaccatggattttgtagatattcgctgtggcttcaccgctgtcggattgtcccaagatgaaaactccgccatcattcacggcattgtcactgataccccagagaacattccagcagatgctcagcgcgaagatatccgagcgaagtatgtcatcggtgcagacggagctaacagtttcgtgcgtaactcccttggcttagagatgaatgatcttggatacttcttcgactggctgatcctggacctcaagccaactcaggacattgactacggaacagatcactggcaactgtgtgatcccaagcgcccaaccaccatcgttcctggaggccccggccgccgacgttgggaattcatggcgctgcctggtgaagatctcaaggaactcgcttctgaagaaagcgcgtggaatctacttgagccatgggatgtcacacctggcaaggccattctcgagcgctccgcagtgtatcgattccaagctcgctgggcccaggaatggcgctccggaagagctctcatcgcaggcgatgccgctcacctcatgccacctttcgcaggtgaaggcatgtgcgctggcctgagagactcactggcgttggcatggcgtcttgatttggtgctgagcggaaaatcagatgatgcattgctagacacctacggagaagaacgccgcgaacacgtccactactacattgatttctccatggacctgggcaatgtcatctgcattactgatgaagatgaagcacgtttgcgcgatgagcgcatgattaaagagcttgaagcacaagacggggtccctgttaataccgatgtcgcacacttgggaccgggaatttgggataaagattcttcccatggtggcgagctagcgaagcagggcatagtggaataccaaggtcgaaaggcgcgtttcgacgacgcagtcggccgtggctgggcagttttaggcctcaacactgatccacgagaagtgcttgatgaggattcgcttgtggcacttgacgccatcggtgcaatcgtcgaatcagtaggtgatgcaacttccgcagttttagatgttgaaggtctttacactcgctggctcaaggaagccggggcaacatttattattacccgccccgatttctacgtctattccacagcagtggacgctgaacaacttcaaacacagattaagcagctatcggatctacttcacctcaactcagttgtcggagcataggagctaaaaatgtctttacagttcgatcatgaaaccctcggtcaacgagttctgttcggttcaggtgaggcggcgcaaaatctcgccgctgaaattagccgactcgatgccaaaaacgtcatggtggttgccggtgatttcgagcttcccatggcacggcaagtagcagcagatattgatgtcaaggtgtggcattcaaatgtcgtgatgcatgtgcccatcgaaacagcagaagaagcacgcagtgttgcgaaagaaaacgacattgatgttgtggtgtgtgtgggcggtggatccacaacaggtctagctaaagcgattgccatgaccaccgcattgccgatcattgcggtacccactacttatgcaggttctgaagcaacaaatgtgtggggattgaccgaagccgcgcgcaaaacaactggtgttgataacaaagtgctgccagtgacagttatctacgattcagcgttaaccatgtctttgccggtagaaatgtcggttgcttctggtctcaatggtttggctcactgcattgattctttgtggggaccgaaggcggatcccatcaatgcggctatggctgctgagggaattcgagcactttctgctggccttcccaagattgtggcagatgctcaggacgtagatggtcgcgatgaagcgctctacggtgcctacctggctgcggtgtcttttgcctctgctggctctggtctccaccacaagatctgccacgtgttgggtggaacttttaaccttccacacgcgcaaacccatgcaacagtactgccttatgttcttgccttcaacgcgccatatgcgccacaggcagaacaacgcgcagcggcagctttcggttctgcgacagcacttgaaggattgcaacagctgcgtgcccaagtgggagcaccacagcgactatccgattacggattcaccgcagcaggaatcccagaggcagtggaaatcatcttggagaaagtaccggcgaataatccacggacggtcacagaagaaaacctcactgcgctgcttaccacagcgctcaacggcgacgatccagcaactttgaattaaggagaccaacatgactatttcagcacaacagcaagcagtggaagaagaccttgtagagcgcgtactcgcatcttttgattcgtgtgaaaaccctcgcctcaaactagtgatgaaatccctgactgtgcatctccatgatttcatccgcgatgttcgactcactgaagaagagtggaactacgccattgatttcctcaccaaggttgggcatatcaccgacgataagcgccaagaattcgtgttgctctctgacaccttgggtgcatccatgcagaccatcgctgttaataacgaagcatatgaagacgctaccgaagcaacagtctttggccccttctttgtcgatgatgcgccactggtccaaaacggagatgacattgcctttggcgcagtcggccagccggcatgggtggagggaacggtcaaagacactgaaggaaaccccattcccaatgcacgcattgaagtatgggaatgcgatgaagatggactttatgatgtgcaatacgccgatgagcgcagtgctggacgcgcacacctgtattcagatgaaaacggcgaataccacttctggggactaactcccgtgccatatcccatcccacacgatggtccagtaggacaaatgctccaagcagttggtcgttcccccgttcgttgcgcgcacctacacttcatggtgactgcgccagagaagcgaaccttggtaacccatatcttcgttgagggcgatccgcagctagagatcggcgattccgtgtttggcgtgaaggactcactgattaagaaattcgttgagcaacctgcaggaaccgcaactccagatggtcgcgatgtgggtgatcaaacctgggcacgcacacgttttgatattgtgctcgcccccggcaatgtctaagtagaagcagcaaaaaaccaccaagaaaaagttcttggtggttttggcaatttgagatgtgttagatgaacatcagcacagcgatgatgacccacagcagagcccagatgccgccgaacatggacagctggctcttcgccttgtcccagttttcgatctcgtaagtctttgcagcctgctcatcgtcctccagaaggtcaagagcacccatcatcttcttctggcgtgggaagataacgaagagaagcagcgcccaggtgataacactgagagcgattgctgcgtggaactggccttcagacttgtagaaagaccaatcgagaagcatgatggcgatacccagcaaaggcacgagcagggacagcatgccgtaggactgggaaatcttgaaaagggtttttgcggagccagcggcttgggtgttgccgttgtgtgcatcgtacgcgcggacgtggaactgagagttagctactgttgctggtcctaggaacaggattgctgcaatagcgtgaatagcgatcatgatggtggtcacgggctggtggacctttcaattatggttgggcaaaaagaaaatgcttgatacatacactaacgagatcaccaaggtttggcgaacccgcactgttttcgtccaacccgaatgtcgttttctggtaacggaagttcgtatgcgttggccacggcgaaaaggcgttccacgtaccaacatcgtgcacttcgatcagaggggagccactcgctgggaagttgatcggatttttcttggttctcagcttttgagacgagcacgaggttgagggggtcgttggcaaagctgattctctcgccagcgctccaccggtgtgcgcctagatcccaggcggcgctgagcgggagaatatgatccacctcggcactagagaggtctaatcgattcccggagtatggatcagtgtcgccggcttcatccacgatgccttcccgcacgccacccaaccatccgccaaacatggaggctctgtcatagcctaggactgtggctcgttgggggattgctgtaactggtgcgaggtctccaggacctcggccaatgtggggagcaacggtatatatacagaggaaaacactaaaggcgatgagtacccgaataaagttcttcatactcgggttagactcatcgccttggcgtttggttccctctaaggcttaactttctttcgaaagcttctgagctgcgtcagcgaaatcaacatcctcgtttgattccacagcggcagcaagatccttggcggtttcaaactcgttgaggatttcttcggagggttcctttgtcaggagggaaacaacgaccatcacgatggttgccaaggcgaaacctgggatgatttcatacaacgtatcgcttagtggggacataccccacgcgatggagacaatagcaccagtaatcatgccggagatagcgccggcggcgttgagacgcttccaataaaggctagcaagtatgatcggaccaaatgcagagccgaatcctgcccacgcaaatcccaccaatccgaggatggaatcagacgggttaatagccatggctgctgcaatgatcgccagaatgatgactgtggcacgagacagcatgatcagggtgcgttcgctcagcgagtcctttttaactaccttcagcaggtcctcaatcagggaagatgcggtgaccagcagctgtgacgacatggtagacatgatggccgcgagaacagcagtcagaataagtccagcgatcaatgggtggaacagcatccgggcaagatctaggaagatggactcataagcccttgtgtcagtgatgttggcgtcggggttttgtgcaaagaaaactgtggagataattgcggtaaaggttgcaccaatcaggcagattatcatccaggaaataccgatgcgacgaccttgctttgcttcagctggtgtgcgaagtgccatgaaacgaaccacaatgtgtggctggccgaagtatccaagaccccaacctaagttaccaatgattgctgctgcagaaatgccactgatcatggagaagtaggtgggattgccaattccatcggtgtgcgggccgtaatcattagagtttgcaaagctccaaatatccatggggttcgccagtgcgaaatatgccatgactggcacgatgatcaacgagaagaacatgatagtcccctgaactgcgtctgtataagacacagcaaggaatcctccaatgaaggtatacagcactgtcacacctgcgacaatggccataccgagtagataatctccaccaaacgtggactcccaatacactccaccagcaaccatgcctgaagaaatgtagaaggtgaagaacacaatgataattagtgctgcaatgatgcgaagcgcgcgagatttatcgcgaagtcggttctcaaagaatgaaggcagggtgattgagttggccgagatttcggaataagaacgaagacgaggtgccacccacatccagttcgcccatgcaccaatggtgagtccgactgcgatccacaactcggacatgccggtgacaaacagcgcgccgggcagacccatgagcagccaacctgacatatctgaggcacctgcggacattgcggcaacaaaagggttgagcccgcggccggcgagcatgtagtcgtcgtatttttctgtcttgcggtaactccaatagccgatgagcaccatcaccaacatatagataacgatggctatgatgaaccaggtgttatcgctcatgaggtttctccttttgggtaggggacaaacgtgcaaagatacaaataaaaaataagcactgtgaactacaacactaatcgacgtgggtgtctgaatatacataggcatgaaaatcacccctatctgcgcggggggcgcgcaacccgggccggggcgggtgaggggtggcgtcgacaagcaaaatcttttaagcagtggtgatttttcaaataaccggtaggctggagtacttgtccaatggtttcgcacaaggttacgagaaaccactcttcaacataggtgaaatgaattcatgacttctcacttgcttcacggtctctggatcaaagatcgcggtctgcaactgtggattgagcaggtcgaagggcaccgaattgtgcttccagaggcggtggaaaaaggcacgttcccgccggtagtggagcaaatcctcgacgggaaaaccttccgcgcgcgcatgaatgtgcatctgcgcactccgaaagggcgccatgttgagctgcccacgccaacagcagcttttacccctgaagaagcagtcacggttttctcacaattaagttttttgaaagcagaaacccctgccgccacccgagcgcaacgtgactccattgcgcccgatctgtggtggctgattgtcatgtatcaaggcctggcgcgttttgtgcaggccggccgcgtcacgcttcgcacggtgatgatggataatgcctggtggccccagtggcaactatctgccagcctgtcggagcgtgggtggctcgcggaaatgaaccatgccgcgccgggtattttgcggattaatggtggccgagatttggccggaagcatgtccaatgagcttccgcactggatcgccaacgccattttgcgtgattaccgcgatgaaaccatgccgtatgcgcgccatgagtttgttgaggcgttgctgtttaaccattcgctgcgcaagggctcgaccatgctcacccatgcgctgaatcagtggaaaaacaccattacatctgcgtctttgcagctggtgattttggtggaggagccccctgcggaatcggattatgaagatccgatggattccgtgtggccggtgcgtttgatggtgcgcacgggcgtggatgcgccgcaggcgattcaaaaaggatcgatcgatagcgggggaatggagcaactgcgctcccaatacgaaaccgcaaaaaccacctccatgctgctggatcctgcgcgcgaagacgcgatgctggggcatatggtggacatcgcccaaaacggtgactgggatattttcttaaccaccgaggagatcgtcaactttatctcccacgatgtagccaagctgcgcaaagccggcattcccgtcatgctgcccaaagcctggagcacctatgaaacccgcgcgcaggtggaagcgcgcacgccgaatgatgccgcggactcttcaaccaaggcaatcattggtcttgaccagctcgtggaatacaactggcgcatcagcgtcggcgatattcagctgtccgacgaagagatgcgcgaactcatcgattccaaaacaggcctcatccgcctgcgcggcgattgggtcatggcggaccaagacgcgttgcgacgcatcaccagctacatggaggaactatcaaagtcctccgaaaaacgcgcgcgcaccgaaatggaaaaagtggccatgcaggccaaactcgccgaagcaaacggcgaagaaggttggcaactcctggctgccaaggctgaaactctccgcaaggaattcaatgagaaattcagtggcgatggacaaggcgaagtaacccttgctgaactgcgcgaaatcgcactgaaagccgccgaaaacgaaccagtggaattcaccggctcgcaatggttcaactccttgctcggcggcaccgaaacacccgcgccggtgcgcgtcgacatccccgacacggtccttgctgacctgcgcgaataccagcgacgcggcgtggactggctgtactggatgtccgcaaataatttaggtgcagtgcttgccgacgacatgggcttgggaaaaaccctccagttgttgtcccttttggcagtcgagcgcgcagaaaacccagagttggaacgcggcccgacgctcgtggtgtgcccaacatctgtggtgggaaactgggcagccgaggcggctaaatttgtgccttcactaaaggtattgatgcatcacggcccgcagcgtttgaatgatgccgatttcctgagtcaatccaagggcatggacttgattatcacctcatacggtgtgatcacccgcgatttcaaactcatgggccaggtaggttttgaacgcgtcgtgctcgatgaagcgcaggcaattaaaaactcttccacacgcgtatcaaaggcagtgcgctcgttgccttcccgccaccgcgttgcactgactggcacgcccgtggaaaaccgcctgtctgaaatgcgctccatcttggacttctgcaaccccggcgtgctgggttctgcatcgtttttccgcaaccactttgccaaggccattgagcgtgaacaagacgacaccatgactgagcgcctccgccagctcaccgcaccgtttattttgcgacgcctcaaaaccgacccgaatatcatcgacgatctgcctgagaaaaccgaacagatcatccgcgtggatatgaccaccgaacaggcatctctgtacaaagcgctggttgaagatgtgcagaaacaactcgatgaacgccaaggaatgtcacgtaaaggcctggtcctggcgaccatcacgcgcatcaagcagatctgtaaccacccagcgcacttccttggcgacggctcagaggtgacactgaaaggtaaacaccgttccggcaaggtggaagcgctcatggaactgatcgatacggcagtaaaagaagagcgccgcatgctgatcttcacccagtacgcagcctttggccgtattttggcgccgtacctgtctgatcgattgggcacgaatatcccattcctgcacggcggcgtgaccaaaccaggacgcgaccgcatggtggcggaattccaatccgaagacggaccaccggcaatgatcctgtctttgaaagccggcggtactggcttgaacctgacagctgcatccatcgtggtccacatggatagatggtggaacccagccgtggaaaaccaagcaactgaccgtgccttccgcatcggccagcgcaaaaacgtggatgtatacaagatgatcacagtcggaaccatggaggaatccatccaagatatcctcgatggaaaaacacacctggccagcgccatcgtgggcgagggcgaaggctggatcaccgaactcaacccagaagaattggctatgctgatgagttaccgcgaaaaggagggtgcagatgactgaatcacgccgcgtgaaaatggataacgttatttacgccaattttggcagcaaacagcgcgtatctactcctgatgaccgcacccaggtgattaataaatcacgacacaaacaattcagcccagcgggtactcgtaccgtgatgttgacggagaaaaacgccgacagcggacgacggtcccgcggtgagcagtactaccgaaacggcaatgtcaccggcatgactgtgctggaaggccgcgtggaatgcactgtcgcgggctcccaaaacgagccgtttgttaccacagtgaccttcccataccgaagctcggaaaaactccgcgaagcctacgcagctattgcggatactcccaatggcctgcggcttgtgcgtgatggccatctgacctcctccatgctggatcacttggtgggaagtcctgatgagtcgatttattttgactgcacctgccccgaccgatcgcttgtgtgtaaacatgccgttgccagcgcgtatcacgttgccgagaagatgaccgcgaaccccggtctgatcttggatattcgtggtcaagggatggctggattagaagcactgattcggacctatcacaccaaggttgaaactgaacctgaagacaatgacagtttttggaacggcagggaacttcctgctttgcctgatccaaagattgcccctgctatcgacgattccgatatcaactacctccacaaggctttaaggatggtctcatacacctccctggagcagcttcgtgcggtcagtgatattgaagatatgtacgagattttggtagccaaccaccctgataaccagcaagtgtatgaggaagaagacactgattaaccagggcttatggttgtggtctacccccgaataggaaaccatgtccaccgtgcatgatgagatgggcgttatgaatacaacagtgaagtttttacactcctcggacctacaaataggcatgacacggtggttcttatccgatgaagcccaggcccgttttgacgatgaccggattagggccatcgaaaagatgggcaagatcgcacggaaaaatcagtgcgagttcattgtgctcgccggcgacgtcttcgagcacaactctttagaacaacgcaccactggacgtgccttagaagccttacgatccttaaagctgccggtttatctgctgccgggtaaccatgatcctttaacagcggattcgttgttttaccgcgccaaagatattgatggcgtgacaatcttgtcggacaccaccgtgcatggggtggcccctggggtggaaattattggagcacccttgctgcacaagatggctacttcagatctagtggcagaagcattgaaagatttggaaccaacctccaacgtccgtatcgctgtggggcacggccaagcagaagctcgcaccactgaccaccgggctgacttaatcgatctgaacactgttgaagccaaattggctgacggtacgattgactacctcgctctcggcgatacccactcggctcagccagtaggtaccagtggaaaagtctggttttctggagctccagagaccacagacttccatgacttagatccagaccgtgtgggcggtgaggtgaactctggcaaagttctcattgtcagcgcctcaaagggtgacgtttcagtcgaagaagtcgaggtggggaagtggaccttccacgctttatctaaagaaatcacctcgggtaccgatgtggaagatttcttggataccttgcaggcataccctgataaatctcgaacagtcatcaaatatggtctccgcggaaccatcaccctggaacaaaacaggcgtttggaagaaggcatcgctgggttagaagatgtctttgcttcactcaagcctcgggaacgcaccactgacctcgtgctggagccaggggaggaagaattagccaatctcgatgccacaggttacgccgctgaagtattgcgagagctcgctgactctgtggtcaatggtgcagcgccggaagaagaccgcgatgcgctcaacctattgttccgactaagccgggaggtctaagacatgcgtattcatgaaatcatcattgacaatttccgagccatcgaacatctagaacttcgtgacattcctgaccagggcgttatcgtgatccacggtgacaatgagcaaggcaaatcttcaatccttgaagccataaaaacagttctgaatagtaaacacagaaccaccagcaagacgatcaaggccattcagcctgttgaccgtgatgttcccatcagcatcaccctcgaggcaaccgtaggcacggttcgattccgcatacacaaacgcttcctaaaatccacagccgcagaactgcaagtcatcgagccacgtccatccaaccaccgtggactagaagccgaagctgcactggcagaaatactggaaagccatttggacacctctttgcttgacgcattgtttatgaaacagggtgaagtagaagcaggtatcagcgctgtaggaattcctaccctgaccagcgctttgaacgctcaaaatggcaataccgaagatgccaccgaagacaccgcactcatggaggctgtagaaaaggaatacctaaagttctacaccaactccggaaaggcgaatacgaggttcctacagttttccaaacaggtggaaacccttcgtactgatttggatgaggctaacgctgaagtagcaaagctctcctcccatgttgaccgagttaaacgattggaaattgatcgggatcaggccacagcacagttacccaaggcagaggaagaactcgcagggaggaaagcagaactggaggaagcccaaaaggttaaggctcaagccacggaaatccttgcgcagttttcccgggcggaagaacagttagagcaggcaacaggagctcagaaacgacgtaaagaactccgcaataagctggaattagcacagacagaagtcgaaaaggctgaagcagggcaagagaacctggcgcaagaagcttcccgtgaagcagaagaattcctagccttaagtgaaaagttcgaggcagcgcgcgcagctgaaactctggccgttgaaaaggtgaaagcagcacgtcaatcggttgctggaatcaaaaaccgtgaccgtaaagaacacctcacggttatgcttggtgaacttgatcgaattgggcagcgcctctacgaattgcgcagcgtccagcactcatcggtgcgtgtgagccagcgtgatattgatgctctgcaaaaggcgatcaccgaggtcgatatccaaaggacgctcgttgaagcgcagcagggaagtattaccctcagtgcttccacacccaccgacattcaactaggtgatgacaccgtttcagctaccgacgctggaaccacagttgccctcgaccgagaactcaccgtcgtggtcggcgatgtcaccttggtgattaacccaggaaaaacagcagcggaaagtcgcaccgattttgaatccgccgaggcagcattggcggagctgcttgatcaactcgacgtctcagacttggaccagctcagggaacgtttcactgcccaagagcaacgagacgcggatattgcagaactggttcgcgaacaacagcgcatgagcggtgggacagaaacaacagttttacgtgccgagctagaaggcctgcacgtcccagaggatctagacccatcaatttctgtggatgatgcgcaaactcagttgaatgaggcagaagagtccagagagctcgctgcggaggcgcataaacacgcaaatgcagcacttgatggattgcgttcgcgtcccgtagataaagctctgacagttttcaacgctcagctcgcagcactgcagagaaacctctcttccgcacaagttgaattagaccgtgcagtggcagaaacctcggatgacgaagttgatgctgctgtacagcggtgcgctgaagctctagctggggtgcgggtacagaagcaggagattgaacaggtcttggcaaaaaccaacccagacatggctcaacgcttatgtgatgctgctgaagcaaatgtgcgatcgtataaaacggcagtgtctgatgccaccacagagttggtgcgcctggaaggcctcatcggtgtagctgcaggtgcgaaagaacgactagataaagttaagtctgcgctgacagcagctgaaaaccggtttgaatcagaacaacgtcgcgcccacgctgcacgtcgcctctatgccctcatggtgttctaccgtgatgaatcccgaaagcgctacgcagcacccttcgcggacaaactatccaggctggcagcatccgtatttggagaatcagcagactttgatcttgatgatgagctgaagatctccagtcgttccataggaccacgaacagtggaccttgccaatctttctggcggcgcaaaggaacagctggcaatcctcacccgctttgctatcgcagaattggtagcagaatcctccgcgcaaggtgctgtgcctgtgtttattgatgatgcattggggagcacagacccagagcgactgacccgcatatctactctgtttagtgatgcaggcaaggactctcaggtgtttgttctcacctgtgttccagaccggtacaactatgtagaggtcacccaaaagcacagcatcgagtcattgaaaactgccaacgctctgctgtagctgagcaaaaagccaagcaagtagctgatcaagtaaccaacccctgcagccactcatgcagcgaaacggagcatttcccatgagtcttcatccagaagcccagcattttgtttagctcacctctaaagctcctgatctggatacgaggactcctgcggaaaaccgtgtggctagtgaagctacccggcatctcatgggggagaagacttctgtcgcgtatgttcacgatgttctgatcaagggcgtgccagtgcggatatacaatccgcaccccaacgacgggccgcttcctgtctttatctacttccatggtggcggatgggttttgggggaccttgaatcagtggattccaccgtgcgcgatattgccgttgcttcaggcgccctgtgtatcagtgtggattatcgccgtgcaccggaacatccttttctcgctgcattggatgattgccaagtggtcacggaagctgtcctcaatggtgaactcgccagtgctaaccagcatctagtggcagtcggcggggacagcgccggtggcaatattgcggcggtcatcgctcaacagctgcgcgatcagatcacccaccaagttcttgtgtatccggtgatggacgtaatcttgctggtgatttgttctatcattaccactggttttgcgctgctcatgcatccaaagagcaaggacaagacggagacgatttctgatgaattcctcgcagagatccaagcgggaagtgaaaagatctccattctgcgttcgacccctgctgaaaaagccaatgcgagccgctggatcatgtacttcgttggcggaattggcctgctctacagcgtgttcagcctgtggacaggtggcgtaaccggactgacgttgaactccttcaacttcctgttcctgtcactcggcatggtgctcaccgctaattacgggccagagtattaagcaaagcttattcgcgaaggcatccaaggaacgtggggattcattcttcaattcccgttctacgcaggcattttcgggttgatttccttcaccggtctgggtgttgtgatctccggatttttcacctcgatttccacggcaaccacgtggcctgtcatcgcgttcctctactctggactgctcaacatcgcggtgccttcaggtggctcgaaattcatcatcgaagccccgtacatcatcccaaccccagtggatcttggcgctgacatgggccttgtcctgcaggcttatcaaatgagtgatggcgcgaccaacctgctcattccgttcttcgcgctgccatatttggccaatttcaagatcaaattcagccaagtggtgggctatacagttccgcctgtcctcgttgttatcgccgtgatctgcatttacctgttcctgcgagcatcaatcatttaaaaagatgcttctcgacgccaaaagccgcggcaccttcagcaattactgaaggtgccgcggctttttgtttgtgggcgcttaagcagccttgattgcggagccgtcgatctcgatcttgatcttctcagaaaccagaacgccaccggtggagagtggagcctggaaatctacgccgaagtccttgcggttgatttcggtggaggcttcgaagccaaggcgggtgttgccgaatggatcctcagcaacgccaccaacctcaacgtccagggtgacggacttggtggtgtcacgaattgtgaggtcgccggtaacggtgccttcgttttcgttcttgataacaaaggaagtagcttcgaaagtcatttcagggaacttgtctactgcgaagaagtcgtcgcccttaacgtgtgcatcgcggtctgcgttgccggtggtaacggaagcggtcttgataacaacctttgcagaggagttctctgggttttcagcatctacgacaatggagtcggtgtactcggtgaattcaccgcgaaccttggtaaccattgcgtggcgagccacgaacttgatttcggtgtgtgcagggtcgagggtccaggtgccagtcaacttgctcattgtgaagtccttttcggtgaaagtgtgtttcgttttttaacggtaccgacactcttgcatctgtgcagtttgtgtcgctgccgttgttcgtgttctatactagccaagattgatgatgtgtcaacaatatttctaaaaaacttgatgtggaaactaaaacccgcaggtggaggcgtgaataaaattgtttgttgggccggagagtgggctgctgtgtattgagcttgtaacagggggttctttgaataaatcttcaggagcaggctagggtaggtgatatgacaacaccacgatggctctccactgaagagcaacaactctggcgcatgatcttgtctgcaacccgcaaaatggaacgcacactagatgagaccctcgtggaaaaccacaacctgaccacttcagaatttgcagtactagttactctttctgaggcaacgggtcagcaaatgcgcctgcgagacatgtgccaagaactagattgggaccgcagtagaacctctcaccaagtcacccgcatggacaaaaagggcttagtggccaaggttaaatgcgcaggtgacgcacgaggtgtgaacgtagaaatcaccccggaaggtgaacgacgcctcaaggatgccgtacctgctcatgtagaaacagtccgccaactagttttcgaccccatggaagaacgccacatggaaggacttcgttcctacctcaccgcagtgttgaactccaacacctgcattgagatcaacaaccaacgcgcggcagagctgtaagggtttacttggagcgttttctcaggggtttttaggggttaggagaggggaaatccccgatgtgctctaggttcttattggcgatgattgaagaagaaagaaaaactcaatcagccataaaggagcttgatcccgatgactttcccagcacaatctcgacgactcgcccgaagcaccaccgacaaatggatcggcggcgtcgctggtggcctcgcagagacctacggttggaatccggcctatgtgcgtctcgcgttcgtggcgtcggttctgtttccactgccaggttcacagatcctgttctacgccctagcgtggctgatcatcccatcccgagaaaatcgcttctaacgtgcgttgcataacgcagaaggcctgcaccagaagttggggcaggcttttttaatatgcaattggtggggtgggactagccaacaaggcgggcgaagcagcgcgacacctgagccaaaccctcattgtcatcaatataaagctcggaaagaggccagctgcgcttcggggtatgaatttccagaagggagtgaactgcttgtccttcggaatggcccagtgcgtcaacctcttcattgcccagggcaactactgacaaggtcaggttggaaggtgaaatgacggggatcatcacctgggttgcaccattgtcgaggtgctcgcgggcgtcagcataaagctcggcaactgaggtgcccgtggtgatgggaacgactggagttagtgggtcgatcatctgcatgacgttgtggacttcattgagtgctttgaagtacacggtggctgtcaggagtcgaagctcggtggtctgcttggcggaagccgggtgcgtcttcatgttcatctttctcaacaatctataaatattcgcaacaactaggggcagtcggtgggaacttacgcaaagtactttcaagcggtaccgactcgaatccaattcttaaatcttgcttaagggaattgtaatctaactcttattatttggcgtcgctgtccaaaagcttagaaaaagatgttttcattagtttagattctctatcagtttagaatagcctgtcacaagcgctgaaccaattaagcggacagcgtgttggctttctcaattaaatacacgtagaagtaccgatgtgattgaattcgctaatctttaagtgaccaaattcgcccccatacagggtttcgttgaaactgaagtttatggggcaaatgaaaatatcctgggtagcatgggcttatgagcactgatagccaaaaccctgtaagaaaatcctgcgcacagccacattcttgttcccaagaggtgcgattgaaagcgatgtccaggtcaccgcttactaaaggtctaaatcaacttgaacacctcgagttagataagtcactaactgcgtggtcgtgggcagaagatgatcctttgtacctcgcaggtgagaacttaaacggcagttacctcattgtcgcaggacgagtgcgggtctctcgcgacaccatcgacgggaaagaactcaccgttgatattgcaacgcccggcgatgttattggtgcgatagatacagaacctcagccggcagtagattccgcttgggcaatagaaaccacctgtgcgctgtttcttccagcaaccgcgttggcaactgtgattgaacagcatccaagttttgctttggcgatgattcggatgcagcagcaacgtttggctacagccagagatcatgaaattaacctgactacgaccacagttgagcaacgagtagctattgcagtgagaactctgggacgaaaaatcgggcaacgacgacccgatggaatcttgctcattcaagttcgaatccggcgggaagatgttgcgggtttagcaggcaccaccgtggaatctacttctagagttttggcgcgattacgtaaagaaggggtcattgatagcggtagggaatggattgccgtggtcgatgaacggcagctagatgccataatcggggaggacttttagtactttccgcttgtttgatctaggtcaaggaacttcactcggctagtccttagactcaaatgtgttcagacaaacactggcaccgtaaggcaccgaaagttaccgaaaggactggttcccatgaccgccccaaacactctcaagcaaacaactcttcgctctgatgagttctcttgcccatcctgtgtctccaagattgaaaacaaattgaatggattggatggcgtcgacaatgcagaggtgaagttctcctccggaagaatccttgttgatcacgaccccagcaaggtctctatcaaggatctagtcgctgcagtcgcagaggttggctacaccgcaaagccatcagcaatctaaaactctcagttagaccattacaagccaccggagccacaagttggaccggtggctttgtcgtctattcggggagtggctgtttttggagctctttgacgcaggtcaaggaagttcagagagcgcaaccataacgttaaaagtaaggaaaagagagaaagggagaaatcatgaaaacgtggaagacctggggggtcgtcggagcttcaggcctcttgattattttgtcgtggttgagttcatcgagcccgatgctggcagatgcattcatgatcgcggctgcaattgttgcaggttggccgatcgcgcagtctgcatatcaagcacttcgcattcgaatggtgtcgattgacttactggtcgttgtggctgccgttggtgccatgttcatcaacaactattgggagtctgcggcggtgacgttcctctttgcccttggcaaggcactggaacgcgcgacaatgaaccgcacacgaaaagcactatcggatctggtggatgcagctccagaaactgcaacaaggctcaacgcggatgactcaacagaggtagttgagctgtgggagcttgagcccggtgacatcgtcttggtacgcaatggcgaacaaattcccgtcgatggaaacgtgattgcgggtgtcggtggaattgatgaatccaacatcacgggtgaatcaatgccggctgaaaagggtcaaggctctgatgtgtatgcaggaacctggctgcgatctggtgttttgagagtcgaggcaacaggaattggttcagactcaactttggcaaaaatcattcaccgcgttgaagacgcccaggatgacaaagcccgcacacaaacattcttagagaaattctctaagtggtacaccccgggcgtcatgatcgccgccgcagtggtgggacttatcacctgggacgtagaactagcactgacgctcttagtgatcggctgccccggcgcgttggttatctccatcccggtgtccatcgtcgcaggcatcggccgtgctgcacgcgatggcgtgctgatcaagggtggagaatacctagaaaccgccgcgaaagtcgacgtcgttgtcgtggacaaaactggaacgctgaccaccggccgcccagaactcacagacgtagaagtcatcgagcccgcctacagccagggcgaggtgctggagctcgccgcgcgcgccgagacggcttcagaacatccgcttgccgacgccatcatccgtggtgcccaggatcgggggctgtccacaacattggtggaagcagctgaaaacatcaccggccgaggcattatcgcaaatgttgatggacaggcagttgctgttggatctgctgagttacttgatcatgaaccagactcgaccaggatcctggagctaaatgccgaaggaaagaccgcgatgtttgtcggagtgaacggacacgccattggaatcgtggccgtcgccgacgccgttcgttcagattctgcctcagcaatcgaatcgctgcataaggcgggcattcaagttgtcatggcgactggcgacgctcaccgcgttgcacaaaacgtggcctccaagctgggagtggatgaagtctactcagagctactccctgaacagaaattagaactggtgcgtgatctgcaagctgccggcaaaacggtcgcgatggtgggtgacggagtcaacgacaccccagcattggcagctgctgatatcggagtagcgatgggcgtggcaggttcccctgcagccattgaaaccgctgatatcgcactcatggcggatcgtctcccacggctggcacatgcagtgaccttggcaaaacgcaccgtaagaaccatgcgcatcaatattctgattgcgttggctaccgtgatggtgttactagctggcgtcctatttggcggagttaccatgtcggttggcatgctcgttcacgaagcaagcgtgctgcttgttatcagcatcgccatgctgttgctgcgtccaacacttaaagaagatgctgcgcaagcaagtgatattaaacgctcggaaatacaacagatcgcataaccaatggctgggtactgatgtggtgatcagtgcccagtttcttctttctactagtgtcggatagaagtacccccagtccagaatgaaggtcaccaccaatgtcagagaatttgccagcgcccgagaatctcctggacgccgagagaattcagatgatcaagaacttccgcaacgaattaacggggttcatgctcaactaccaatttggcattgatgagatcctgaccaagatcaacatcctgaaaactgaattcagccagctgcacgaatacgcacctatcgagcacgtatcttcacgattgaagacaccagaaagcatcgtcaaaaaggtcatccgaaaaggagacgagctctccctcgcagctatcaaagacacagtgtttgatatcgcaggcattcgaatcgtctgcagtttcctcaaagatgcctacgcaatcgccgatatgctgaccaaccaaaaagacgtcacggtcatcgaggccaaagactacatcgctaacccaaagccgaacggctacaagagtttgcaccttatcctccaagtgcctgtcttcctgtctaactccgtggaaaaggtcaatgttgaagtccagatccgcaccattgccatggacttctgggcaagcctcgagcacaaaatctactacaaatttgaacaagaagttcctcagtcaatccttgatgagctcagtgaagatggaaagaatccacggggaagtgaagtcacttaaacctccagttgaaaccactgacagcggagaggcgaagttaccctctgcgataactttcaacgagatttttggtcgagacttcagcgcttgaaagagaatttgatgcacaaggattttgagagagacactgcgaaatatagtagagacgtcttttgaatcccagttctggggtagatccaagattatcgatttcctcgttcgcctagaagcgttgaaaagccccttaaaagtggcattagaggtaaatagtctccatcactgtgtgatggggactatttattacgtctatttgcggtttgttctgtttttaagtttggcttcagaagtgacaaaaccaaagttgattcgacgcttatttgctaagtatagatccgggtcctcttgaagaagcagaatgcgatcgactcggtgagctcagccattctcttgcttcaaactcattaatatgcccttttagaggggagtcgacggttagcaatccagaaaatacattgtcggaactgaccggcatatttgcgtaggtttgatactcgtcattcgttgttgatccatcagggtgggcatcttctacgaatcttccttggttctttgcaagatattgagtcagaaagactatgaattagttagactgcagagccgtcgaaaaggtttcctgcgaggtcaaaattgaccacgacaattccatgacaagcgggattactttgccctacttcgggttccctcgtggaatagtaaaacctccaacatactgtgcaaacagcatgttggaggtatttaatgtgcccccgataggagtcgaacctacgaccttcggtaccggaaaccggtgctctatccactgagctacggaggcgaaccgtcaccatctcctttagtgggtgatgacaacggtgtgattctatcaccatctactaagtggaaagcaattagccagccgtaattggggtgggtgtgttgccttcgacccaggtggcgtcggtgtgtccggtgcggaggtagtccacaacaatgtcgttgattgcttggttggtgccgccgatggattggccgtgtcctggtccgttgacggtgaccacgtgggcgttcatggcgtcggcaagctcgttgtgggtccagtatggggtttgtgggtcgctggttccctggaggagtagtggttggactgctagttgagatccgtcggttggctggcggccgcttgttggggtgatgccggagcaggcttgtccggagctgaatttaacggagtaaatgtcaaagacgtcgccggtgaccatgcttgtccaggccatgcgtgccattgctactgggtctggtgcgacggtgttttcgttgcacatgaccatgcgctgcatgttgacgctggcgttgatgctttcgatgacgtatgggtcgtcgccggtgtcagttacgtcagggatgggtgtttgccctgagatggcgcctgcgagcatgggccaggttgatggctgtgggatgtaggcgcgggtgacgttgagcagagggctcagtgactggttggatccagggtttaggagctgggtggcaaggccctggagttgcacggaggttgggttggtggcggtcatcatgtctgcgcctgcttggccggcccatgcgaatgctggtgggacatcgccaacttgtgctggtggtggagcaacggttgggttggttccggtttcggcgacgatcttgtttgaccagttttggtacacggctagtggggtagtgccgaggccatacgtgtcgttgttttctgcaacccaggtgaagaagtcgttgagggagtttttgtagccctgttcttgggaggccatgatgccgttccatgccaggctgggcgccattgcggaatcgaggacaaccttgtcggtgtgctgtgggtagcgggtggcgtagaccgatccgaggtaggttccgtaggacagtccgaagatggagatcttgtcatcgccaagtgcttggcggacgcgctcccagtcgttggcggtgttgtcggtggtcaggctggaggtgtagccgggggtgccgatctcgcaggattctttaacgaaagcgccttcgcgggtgagcagcgagaggaaatcgtatcctggtgcgatgttgtcgcagttaaccggtgtggagccgaccattccgcgaggctgcactgcaacgaggtcgtagttttggtacatggcttctggccagttcatggattggctgccgaagaagctataggcatcgccaccagggccaccggagttaccgaagatggtgccgtgcttttcgccttgggcagggaccttgacaaagcccacgctgatatcgccaagtgagggatcagaatagtgcatgggcacgtcgatgctgccacattgagcggaggcaatatctacctgaggtgggcattcttcccagcggatgttttcttgcgctgctgcagtgggcattgataccaaaaaggggctaagcgcagtcgaggcggcaagaactgctactaccctttttattgtcgaacggggcattacggctccaaggacgtttgttttctgggtcagttaccccaaaaagcatatacagagaccaatgatttttcattaaaaaggcagggatttgttataagtatgggtcgtattctgtgcgacgggtgtacctcggctagaatttctccccatgacaccagctgatctcgcaacattgattaaagagaccgcggtagaggttttgacctcccgcgagctcgatacttctgttcttccggagcaggtagttgtggagcgtccgcgtaacccagagcacggcgattacgccaccaacattgcattgcaggtggctaaaaaggtcggtcagaaccctcgggatttggctacctggctggcagaggcattggctgcagatgacgccattgattctgctgaaattgctggcccaggctttttgaacattcgccttgctgcagcagcacagggtgaaattgtggccaagattctggcacagggcgagactttcggaaactccgatcacctttcccacttggacgtgaacctcgagttcgtttctgcaaacccaaccggacctattcaccttggcggaacccgctgggctgccgtgggtgactctttgggtcgtgtgctggaggcttccggcgcgaaagtgacccgcgaatactacttcaacgatcacggtcgccagatcgatcgtttcgctttgtcccttcttgcagcggcgaagggcgagccaacgccagaagacggttatggcggcgaatacattaaggaaattgcggaggcaatcgtcgaaaagcatcctgaagcgttggctttggagcctgccgcaacccaggagcttttccgcgctgaaggcgtggagatgatgttcgagcacatcaaatcttccctgcatgagttcggcaccgatttcgatgtctactaccacgagaactccctgttcgagtccggtgcggtggacaaggccgtgcaggtgctgaaggacaacggcaacctgtacgaaaacgagggcgcttggtggctgcgttccaccgaattcggcgatgacaaagaccgcgtggtgatcaagtctgacggcgacgcagcctacatcgctggcgatatcgcgtacgtggctgataagttctcccgcggacacaacctaaacatctacatgttgggtgctgaccaccatggttacatcgcgcgcctgaaggcagcggcggcggcacttggctacaagccagaaggcgttgaagtcctgattggccagatggtgaacctgcttcgcgacggcaaggcagtgcgtatgtccaagcgtgcaggcaccgtggtcaccctagatgacctcgttgaagcaatcggcatcgatgcggcgcgttactccctgatccgttcctccgtggattcttccctggatatcgatctcggcctgtgggaatcccagtcctccgacaaccctgtgtactacgtgcagtacggacacgctcgtctgtgctccatcgcgcgcaaggcagagaccttgggtgtcaccgaggaaggcgcagacctatctctactgacccacgaccgcgaaggcgatctcatccgcacactcggagagttcccagcagtggtgaaggctgccgctgacctacgtgaaccacaccgcattgcccgctatgctgaggaattagctggaactttccaccgcttctacgattcctgccacatccttccaaaggttgatgaggatacggcaccaatccacacagcacgtctggcacttgcagcagcaacccgccagaccctcgctaacgccctgcacctggttggcgtttccgcaccggagaagatgtaacaatggctacagttgaaaatttcaatgaacttcccgcacacgtatggccacgcaatgccgtgcgccaagaagacggcgttgtcaccgtcgctggtgtgcctctgcctgacctcgctgaagaatacggaaccccactgttcgtagtcgacgaggacgatttccgttcccgctgtcgcgacatggctaccgcattcggtggaccaggcaatgtgcactacgcatctaaagcgttcctgaccaagaccattgcacgttgggttgatgaagaggggctggcactggacattgcatccatcaacgaactgggcattgccctggccgctggtttccccgccagccgtatcaccgcgcacggcaacaacaaaggcgtagagttcctgcgcgcgttggttcaaaacggtgtgggacacgtggtgctggactccgcacaggaactagaactgttggattacgttgccgctggtgaaggcaagattcaggacgtgttgatccgcgtaaagccaggcatcgaagcacacacccacgagttcatcgccactagccacgaagaccagaagttcggattctccctggcatccggttccgcattcgaagcagcaaaagccgccaacaacgcagaaaacctgaacctggttggcctgcactgccacgttggttcccaggtgttcgacgccgaaggcttcaagctggcagcagaacgcgtgttgggcctgtactcacagatccacagcgaactgggcgttgcccttcctgaactggatctcggtggcggatacggcattgcctataccgcagctgaagaaccactcaacgtcgcagaagttgcctccgacctgctcaccgcagtcggaaaaatggcagcggaactaggcatcgacgcaccaaccgtgcttgttgagcccggccgcgctatcgcaggcccctccaccgtgaccatctacgaagtcggcaccaccaaagacgtccacgtagacgacgacaaaacccgccgttacatcgccgtggacggaggcatgtccgacaacatccgcccagcactctacggctccgaatacgacgcccgcgtagtatcccgcttcgccgaaggagacccagtaagcacccgcatcgtgggctcccactgcgaatccggcgatatcctgatcaacgatgaaatctacccatctgacatcaccagcggcgacttccttgcactcgcagccaccggcgcatactgctacgccatgagctcccgctacaacgccttcacacggcccgccgtcgtgtccgtccgcgctggcagctcccgcctcatgctgcgccgcgaaacgctcgacgacatcctctcactagaggcataacgcttttcgacgcctgaccccgcccttcaccttcgccgtggagggcggttttgggtttctgggtttctttgcgaacttaaggtgtctaggggtctgcagtcgaggcttcagaggttttattgctcgacttcacgtgtgctgacttcgcgtgctcaacttctcatgaggcgacatcagtcgaaaagccggtcattgtcgtatgaagtctgcgcacgagaagttgagcggaagaagtcggtgttaagaagtcgaccgcgtgaagtcgccctttaggagaattctgactaactggagccaaaacttgatccactcgagagctgtgcagtctctttttccttcaattctgcctgctcgagctcgtagaagtagaggtctacttcagttggttcaccttgcacacaagcatgaagtagtgggtaggtcgagttgttaaatgcggtgtagaaggggagtagttcgctagcaaaggttaatttggagtcgctgtactgcgggttctcgggtggagtattcccggaggattcaagaaatcttgacgcatctttgatgaggtatgtttggaattcgtcggcaccttcctcgccggagaggtagtaggagttgtcgtaatttggaacccagatggcaaatcgtgcgttttcgattgcgtccaggagttcctctacgttgtatctcgcacttgttgcagcggaagcgactcggttgccgatgtctccgtatgcagtgagcgtggcgtttccgaggggaacttgatcagaggaatacaccatggagccgatgtcagaggcgactgcgggcagatccttttgaagctgtttcacaatttctttgcccagttcgcggcggatctggaaccacttttgcatgcgatcgtcgtcagagtggttcatgtgaaaaatacactcaccatctcaatggtcatggtgaaggcctgtactggctgcgacagcatggaactcagtgcaatggctgtaaggcctgcaccaacaatgattgagcgaagctccaaaatgtcctccccgggttgatattagatttcataaatatactaaaaatcttgagagtttttccgttgaaaactaaaaagctgggaaggtgaatcgaatttcggggctttaaagcaaaaatgaacagcttggtctatagtggctaggtaccctttttgttttggacacatgtagggtggccgaaacaaagtaataggacaacaacgctcgaccgcgattatttttggagaatcatgacctcagcatctgccccaagctttaaccccggcaagggtcccggctcagcagtcggaattgcccttttaggattcggaacagtcggcactgaggtgatgcgtctgatgaccgagtacggtgatgaacttgcgcaccgcattggtggcccactggaggttcgtggcattgctgtttctgatatctcaaagccacgtgaaggcgttgcacctgagctgctcactgaggacgcttttgcactcatcgagcgcgaggatgttgacatcgtcgttgaggttatcggcggcattgagtacccacgtgaggtagttctcgcagctctgaaggccggcaagtctgttgttaccgccaataaggctcttgttgcagctcactctgctgagcttgctgatgcagcggaagccgcaaacgttgacctgtacttcgaggctgctgttgcaggcgcaattccagtggttggcccactgcgtcgctccctggctggcgatcagatccagtctgtgatgggcatcgttaacggcaccaccaacttcatcttggacgccatggattccaccggcgctgactatgcagattctttggctgaggcaactcgtttgggttacgccgaagctgatccaactgcagacgtcgaaggccatgacgccgcatccaaggctgcaattttggcatccatcgctttccacacccgtgttaccgcggatgatgtgtactgcgaaggtatcagcaacatcagcgctgccgacattgaggcagcacagcaggcaggccacaccatcaagttgttggccatctgtgagaagttcaccaacaaggaaggaaagtcggctatttctgctcgcgtgcacccgactctattacctgtgtcccacccactggcgtcggtaaacaagtcctttaatgcaatctttgttgaagcagaagcagctggtcgcctgatgttctacggaaacggtgcaggtggcgcgccaaccgcgtctgctgtgcttggcgacgtcgttggtgccgcacgaaacaaggtgcacggtggccgtgctccaggtgagtccacctacgctaacctgccgatcgctgatttcggtgagaccaccactcgttaccacctcgacatggatgtggaagatcgcgtgggggttttggctgaattggctagcctgttctctgagcaaggaatctccctgcgtacaatccgacaggaagagcgcgatgatgatgcacgtctgatcgtggtcacccactctgcgctggaatctgatctttcccgcaccgttgaactgctgaaggctaagcctgttgttaaggcaatcaacagtgtgatccgcctcgaaagggactaattttactgacatggcaattgaactgaacgtcggtcgtaaggttaccgtcacggtacctggatcttctgcaaacctcggacctggctttgacactttaggtttggcactgtcggtatacgacactgtcgaagtggaaattattccatctggcttggaagtggaagtttttggcgaaggccaaggcgaagtccctcttgatggctcccacctggtggttaaagctattcgtgctggcctgaaggcagctgacgctgaagttcctggattgcgagtggtgtgccacaacaacattccgcagtctcgtggtcttggctcctctgctgcagcggcggttgctggtgttgctgcagctaatggtttggcggatttcccgctgactcaagagcagattgttcagttgtcctctgcctttgaaggccacccagataatgctgcggcttctgtgctgggtggagcagtggtgtcgtggacaaatctgtctatcgacggcaagagccagccacagtatgctgctgtaccacttgaggtgcaggacaatattcgtgcgactgcgctggttcctaatttccacgcatccaccgaagctgtgcgccgagtccttcccactgaagtcactcacatcgatgcgcgatttaacgtgtcccgcgttgcagtgatgatcgttgcgttgcagcagcgtcctgatttgctgtgggagggtactcgtgaccgtctgcaccagccttatcgtgcagaagtgttgcctattacctctgagtgggtaaaccgcctgcgcaaccgtggctacgcggcatacctttccggtgccggcccaaccgccatggtgctgtccactgagccaattccagacaaggttttggaagatgctcgtgagtctggcattaaggtgcttgagcttgaggttgcgggaccagtcaaggttgaagttaaccaaccttaggcccaacaaggaaggcccccttcgaatcaagaagggggccttattagtgcagcaattattcgctgaacacgtgaaccttacaggtgcccggcgcgttgagtggtttgagttccagctggatgcggttgttttcaccgaggctttcttggatgaatccggcgtggatggcgcagacgaaggctgatgggcgtttgtcgttgaccacaaatgggcagctgtgtagagcgagggagtttgcttcttcggtttcggtggggtcaaagcccatttcgcggaggcggttaatgagcggggagagggcttcgtcgagttcttcggcttcggcgtggttaatgcccatgacgtgtgcccactgggttccgatggaaagtgctttggcgcggaggtcggggttgtgcattgcgtcatcgtcgacatcgccgagcatgttggccatgagttcgatcagggtgatgtattctttggcgacagcgcggttgtcggggacgcgtgtttggaagatgagggaggggcgtccgcgacctttggctgctgcggtgactactcggatggcttcttttgctacgagttcttcgaggtggccgcgggcggtgttgacgtgaaggtcgagttttttggcgacatcgatcgcgcgggcaccgtcagggaaggtttgtagggcatctaaaacttcgcgctgctttgggctgagtttgtaggactcggcaaaaagatcggaggctgcggtaggggcggtttgtgtggtcacgtcgggctcgctctggtggggttctcctcgtatcggtgcttagcagatgttatggagaaaagtgtattaattgattaattaaatatagggaatcataccatatttaatactgtaaaaccctaaacaatgttttgtttaccaagcaacaagccccctgagattaactagggggcttgtgaggaatttaggcgccgtgccatttcgagtcattgtcgagctgatttttgaccgagcggatcggttcccaggcgacgttttggcgtgccggttcagaggtggtgtcgcgggtgcgatagaccacgtaggggcgggtgacgtatccaactggtgcggagaacgcgtggactaggcgggtgaatggccacagtgcgatgagggtgaatccagcgacgatgtggaccttgaattcccaagggacatcagccatgagctctggttgagcgttgaagatgagcagttggcgcagccatggggagatggtttcgcggtagtcgtagccgtgtgcgccgccgaagacctgggtggagacggtggcgatgaaaccggacaaaattgcagcgccgagtagcacatacatcactttgtcggagcgtgaggtggacaggaagacggttttgttgatcacgcgacggataatcaagccgatgagtccaaggactgcagcgatgccggcaatggtgcctgggatggtggcgatgaggtggtaagcggcgtcagaaattcctacagcttgggtccagctcttggggatggcaagtcccatgaggtggccgatcaccacgaacaccatgccccagtggaagagtggggaggcgatgcggaggagtttggattcgtagatttgggaggagtgggtggtccaaccgaattggtcggcgcgccagcgccaagaaatgccgatgatgtaggcggcgatacacagccaggggtaggcaacccagaggaacgtttcaaagtttgacatagtgtgtcctagtgaatgtccggttgtgaggtggggaacggtagaggcgtgccgatgcccaccatttctgctggtggaccgctgcggatgagctccatgtagctgttggcggtttcttcatcgatttctggcaatgcctggcacaaagacatgatcaggtatctgtagggcgagtcgaggttgtcgagggctgcgcgcaacacttcgatgccgtcgcggtgagctgataacacctgggtggcggcgtcgaaaagcgaagaatcagcaagcgctgcggcctcaagcacgacgcagaggtggtcgggcaattcgtcgcgctcggattcaaatccgagctgttgcagcgtttgacggaaggtgaggatcgccgtgccgcgctgccgggtgtcgcccacagcgtagtaggtgagaaacagtgagcagcgtcggcgctggtcaaaggtctcaacgtaggcttcctgcatggcgcgtagcccagcgacgcgtgccgcgtcaaggaactcgaccacgtgcgccgcgacggggagcggaaggacatcaagctgcgcctcgacggcatttagcttgtcgacgaatccctcctctggataatccaacagcaaactattcagcatgaacaccacgcgccgctgctcctccgtcatggagatgcgaggcacaaagtgatccggaattttgccagtatgggtgcgcatccgcctagtccttccttggtgggaacatcgcagcggggcgttcgccaacgttccacgaggtcagactcaccttgccgctgggagctcccgtgccacaggcctctggagcgccttcgcccaaaccgatgttgagctgctcggtggctcgggctggatcgacatcgccgaaaggatccagggaagaaattccgcgcggggtctcaggggaggcggtggggatgacatagcgatcgtcatacttggcaatggccaggatgcgatacatttcctgcaccaccttgccggtcattccgacagcctctgcgatttcttcctgaggttcgcggcccaaactgatatcgcgcatatatgatcgcatggcggctaggcgtcggagggatttttccaccggcctggtatcaccggcagtgaacaatccagccaggtattccagcgggatgcgcatggtggacagcgcggtgagcaggatcttgtggtcttcgccgtcgttgccggacgcggtcacctcatcaacgatggggcttagtggcggaatgtaccaaaccatcggcaaggtgcggtattcagggtgaagcgggagggcaacctcgtatttgaagatgagatcgtaaattggagagttctgcgcagcttcgagccaggagtgcgggatgccgttgcgttgggcgtcggcgatcacctgtgggtcgtggggatctaggaagagggtcttttgggcttcgaaaagatccttttcgtctggcgtggcggcgacttcagcgacacggtcggcgtcgtaaagcaaaacgcccaagtagcgcaagcgacccacgcacgtctcggagcacacggtcggctggccgacctcgaggcgcggatagcacagcgtacacttttcggccttgcccgatttgtgattgaagtagacctttttgtaggggcagccggaaacacacatgcgccagccacggcattgatcctggtcaaccagcacgatgccgtcttcggcgcgtttgtacatagcaccggatgggcaggaggacacacaggtggggttgaggcagtgctcgcagatgcggggcaaatagaacatgaaggaatcttcgatttctttttgcaccgtgaggttcatcttctccaggacgggatcctgatcaagcgtggtggtggatccgcccaggttgtcatcccagttggatgaccactcaattttatcgatgggacggccatccaactgactgaccggacgcgcagtgggctgtgttttctgacccgctggcgccgagagcaacttgtcgtactcataggtccacggctcgtagtaatcatcgatggtgggcagcttcgggttgtggaagatggtcgccagcttcttcaaccgaccaccggccttcggcttcaatttgccggagttggtgcggacccaaccgccttcccacttatcctgatcctcccagccgcggggataacccacgcccggacgggtttccacgttgttgaaccaaatgtattccgtaccttgacggttggtccaggcctgcttacacgtgacagaacacgtgtggcagccaatgcacttatccaagttcatgatcattgcgatctgagccatgaccttcattagtactgcacctcctgggagcggcgacgaattctggtgacctcatcgcggttatttccggttgggccgatgtagttgaagccataggttaagtggccgtagccaccggcaacatggaccggcttaatcatgattcgagtaagagagttgtgagttccgccgcgcctgccagacttctcgttcagcggggtgccagcggtgcgttcctgcgcgtggttcataaacacggtgccttcaggaatgcggtgggagacaatcgcacgagcagaaacaacgccgttgcggttataagcctcgatccaatcgttgtcagcgataccgagtttctctgcatccttgttggacatccagatcacctggccgccacgagaaatagaaagcacatgcagattgtcgtagtactgcgagtgaatcgaccacttgttgtgggtggtcagataacgcacggttacttctggttcgccgtcggtgcctgtgaccgactggccagggccgacctcaccattgatgtggatcttgtccaacggtggcctaaagattggcaactgctcgccgtaatcaataaaccaatcgtggtcgaggtagtagtgcatgcgaccagacagggtgtgccacggcttgtcgtattcaatgttgatggaaaacgcggtgtagcgacgtccgtccttcttggaaccagtccactccggtgaggtgatcacctcggcgggacgttctttgaccatgtcccaattgatgtgggtaccttcgtggtctgcaatcagatccatcatgtcggtgcccacgcgtgcaccctgattcttgaaaccttcggcggcaacctcaccattagacacgccacttaagtgcagaatcatctcaatggccttgactgcggaatcaagtcgggggcgttcaccagcagactccgtgatggaggtgccgttgatcagcgccagctcctcggtttgcttggtcacgttaaacgcagtgccgtgggttccggtacccgctttggcggtgagtggtcccaagtgtgtccacttttcatacaccttggagtaatcacgttccaccgggatgatcttggccatcgtcttgccagggatcagcccgacctcatcaatatctggcacgataccgccaggcatattgagctcatccggggagtcatgggcaatcggtgcggtgatcacatcggtttgggtgcccaaccaggttgctgcctgtgaggagaattctttggtgagatcgtggaagacctcccagtcagtacgcgtctcccacggtgggttgatcgcagcattgaacgagtggatgaaggggtgcatatccgtggtggacaaatcatgcttctcataccaggtggctgccggcagcacgatatccgagaccaaggtggtggaagtgttgcggaaatccgtggtcagcatcaaatcgagctttccttccggagcctcatccctccacacaatggaacttggacgatcctccggcgcgttttcttcagcagatgcatcagaatccacacccaacatatggcgcaagaaaaactccgtgcccttagctgaagagcccattaggtttgtgcgccagttaagcagaatgcgtggccagttttccggtgcatccggatcctcgcaggcgaactgcaagtcaccatcggtgagctgctgaacaatatggtcagaaacagacacgcccttttcttccgcctcctggctcaagatgaggggattgcggttgaattgcgggaatgacggcatccatccacgtttcatggattccaccaaggtatccgccgtcattttgtcacccacggtgccacgattagccagtggggaagccagacgattagcacgagtgttgtcatacctccactgatccgtggtgaggtagtagaaaccagtggtgatcatctgacgtggtggacgctgccagtctgtagcaaaggcatactgtgcccaaccattcattggacggagtttctcctgaccaacgtagtgagcccaaccgccaccgttaacaccttgggtgccacacatagaggtcagcgccaagaatgtgcgataaatagaatccgcatggaagtagtggttcacaccagcacccatgatgatctgggaacggcccttggaatcatcagcattctgagcaaattcccgacccaaacgaatcgcctgattagcaggaacacccgtgagctcttcctgccacgcaggagtacccatgactggatcctggaaatccttaggccactcaccaggaaggttgagctcttcgcggttcacaccgtagtgtgcgagcaacacatcaaagacagtggtgtactttcggccattcaacgtgatggtgggaacgccccggctgatggtgccagcaccaatggggccttcttgggtggcagttgctgggagatcgaagcgggggaagaggacttccgcagtttcggtgtcagtctgtacatctgcaatagtcatcactggatctacgccgtctaagcgcagattccacttacccatgccttcttcaccccaacggtccgcgacagtgccaccgggatctacaactgagccatctttttgcagcacaaggagacggtgggtggcatttggagtggcggcaagcgctggggagatatcagctgcgcggtctgcagtgaggaatttacctggggtgtaggtgccatcgccgtgctcatctaattccacgaggaaaggagagtccgtgtatttgcgcatgtagtccatgaagtacggcgtcttcttgtcaacatggaattccttcaagatcacatggcccatggcaaaggcgagtgcgccgtcagtaccagggtggatgcgtgcccattcatcagcaaatttggtggagtcagcgaaatccggggaaaccacaacaaccttggtgcccttgtagcgggcttccaccatgaagtgggagtcaggcgtgcgggtcaccggaatgttggaaccccacatcatgaggtagctggagttgtaccagtcgccagattccggaacgtcagtttgatcgccgaaagtttgtggtgatgctggtgggaggtcggcgtaccaatcgtagaaggacagcgccactccgccgatcatctgcaagaagcgagtaccagcaccgtaagacacctgcgacattgcgggaataacggtgaatccatgaatgcggtcggggccgtattggcggatggtgtacacatgggctgccgcagcaatctccatggcttcctcatactgaacgcggatgaggccacctttgccccgctgggatacatatgctttgcgcttttctggggtttctacaatgtcgcgccacgccagcaccggatcgcccaggcgttccttggcttcgcggtacatatcaactagcacgccacggatgtatgggtagcggatgcgggttggggagtaggtgtaccaggaaaatgatgcaccacgagggcagccacgtggttcatagtcgggcatatccgcaccggtagttgggtaatccactgcctgggattcccaggtgatcacaccgtcttttacatacactttccacgagcaggagcccgtgcagttcacgccatgtgtggagcgcacgactttatcgaaagcccatcggttgcgataaaacacatcggcttggcgtccgccctgaaggaaaatctgctggccttcagaaccgacggtgccttttcttaggaaactgccgagcttgaagagggggttgatcttttcagaagacttcccagaagaagtagttgtagtcatggattggcctttcggtttatcccgggaatggagcgttcgggcgggcgtagtagatccaggtcaaagcggtggcgatgatgaagaacaccacgcagccccagaagaacgcgacagttggagtgaaggagagcaagacaccgacaatgaaggggccgaaggcaccaatggcaccggtccagccgatcacgccacctgcttggcgtttaggcaaaatcatgggcatttgtttgaaggtgccagcattgcccagaccggtgaagaagaacagggcaagcatggaccacaggaatggccagaaatcatcaggtgtctccgctctgcttaggaagattgcggcagctgcagtggcgatagtcattccgatgccaccgacaaaggtccagatagctccaccgaatctgtcacacagtggaccccatgcagcacgcaccaaagcaccaatcaaaggtccaagaaacgcgaacgtagcaccggcgtgaagcatctcagctggataagtctctgccatcggggaagcgatgccgaagttgttgttgatgatcagaccgaactgcgcggcgaaaccggcgaaggcaccgaatgtcatcaagtagataatggacaaaatccatgtgttcttgttgccaaagatatcgatctgttgccggaaatttgcggtgactgggacatctttaagaaacaggaaggataaaacggccgcgagaatagtccacgggaccaacacaatcgcagcattgtgcacaaacaccgtggtgccttcaatggtgcgctgcggggtgaggaaaccaatgcccagcagaccgaaacccatgacccatgggcccatgaactgaattatcgagacgccgaggttgccgatacctgcctgaatgcccagcgcagtgcccgattttgccttggggaagaagtatcccgtggacggcatatatccagagaacacgccaccaccaatgccagtgagtgcagcgagtgtgagaagccaccagtagggagtgcttgaatcttggacagccaggaaccacccaaacatggggatcaaaaatagaccggaggaaattccgaccaatttgcgggttccaagaatcggtggaaggaacatgtaaatcaatcggattaatccgccggccaaaccggggatagatgcgagccaataaagctgacctgctgagagatcaaatccaattcgattgagtaggggagcgatggcagaaaccaaataccacacgcagaacccaataatcatggagaaggtggtaatccacagggttcgccatgcaattttcgagtcccaatgttcaggatcttctggatcccacccttgcagaacaacgcctttggtgttgagttgtgtcacgtgatgcctcttcatggttacgcggaaaggctttccgtcaagcccgccctatggctgtgataagtactaagataacagctctgacctgcgcccgcatgtttttcaacggggttttccgtatttaattaggcaacatatttgtgtcgtaattcactttatgcaggtaaacgaatttgtgcttatatcaacattcgtgattcggcaaaattaattaaactgaaaaaggggattaattacccccacttgaggagaaattgatgcccgcacagaacaaaaacctcccaggatccgtcatcgttgtgtctgatcggattaaatcgggagaaagaattgataaagcaggacccgtagcagtagaccttcttcaggaatcaggcgtggagatttccacattcaccgtcgtggaggagggctttgaacctgtccatcaagaattggttaaggcgttggcgcgccgggatcgcgtcatcatcaccatcggcggaacgggcgtggggcctagaaatcggacgccggaggccacagaaccgcacatcgatacgctactgccgggtctgatgacgcagattttgttctctggactgtccaataccgcgcaggcggggttatctcgggggctggtgggcttgagtgctcgcgattccacggccgcgctcatcgtcaacgcgccgagttcttccgggggcgtgcgcgacgcgctcggggtggtctgcccgcttttcggttccatttttgagcgtctttaaaagatttttgcttatcgacgcctccctccacttcaacaatgtttaggcgcgcaaaaacccgacggcgataaagcacgccgtggggttggcgaaggcttaaaggtcgaacatttccttgattgctggtgggaaaccaaactgggtgaatgcaccgaagatcagtgctgcaatgccacccagggctgccacgatggcaagaattccgccagcagaagagccagtttcctttacgtcatcagaaggtgcgcctgtagtaatcacgacagagccgttgtcgtagctcacctgagcgtcaactgcgccatcaacaataacctcatcaaattcaccggaaattgatgcagcatcgatcacggtgacgtggttggtgccaacaggaagggcaacgtgcagagttcctcccaggtttgcggttccatccacggtgacaggctgggtgatcttcaaggttgcaccatcgttgatggtgagatcgcctgctcccagagctgactcagttgcagcaaccaaggtgcccgcggtgatggtggttccaccggtgtaggagttgtcacctgacagggtgagttcaccggaaccgttcttggtcagggatcctgcgccctcgatgtcgttttgccagttgtctttggcgttgtagccaccgtcgatggcattcatggtgacgtcaacgttggtatcgaatgcactgtagccagcctgggcagcgtagaggttgagacggccccaaccttcggcatcatcaagtactgggaaaccggactcgaggccagtggaatgtagaacccaacggcgctgttcgtcatcaaggtacggaaggcgggtttccagcagagcctcagctccctttggcacgcgcatgtcttgggtggtgtcgccggactgctcgaagccgaaggtgaggaagttggtgtactcggcgagttgctcatcaaaatcgcgagtgttggtggtgatgtcgctctggttactgatccatgcctgagcatcatcgaaggcttcagccttcaccgagtcgagattcggatcattaagtgcacctgcagtaatcgcggtggatagaacacggccgccaataacatcaagcggagagtgcatgcccagctggatgcggctttcgccgatttccgctgcagtcatgagcagtttatcgtattgctgtgggaaagcgtaagccaggccgttggttgccatgccgcctgcggaggtgtgtccggaagggaaaccgccatcgctggcagcttcggattcatccttgcgcagtgggtttgcatactctggcatgtcaacgccctcgccccaggcttctggttcgatggattcagtccagcggtaggggcgtgggtattggtagtacgccttggcattgttgctggttgcggcatgctgacggatagcttcaattagatcaacagtggatccgagttctccaccggtctctgcccaattgccattcacattgccgccatcgttgtacttcacggtggtggcatcagctggaacaacgtcagggatggtggtgcccacctgtgcggtctcgcggtaactatctgcgtatgcgccaagaccgtcggttgcggtgtagttctggttgcggcgatcaataacccaagcacgttcttgctgagcatcggtcgcctgctgggagattgccacagactgtgcgatgttggaatccagcacggtggggtcaaccttgacgccggtgttccattcttcgcctggggtccacagctcaagcatttcctccagtacgccaacagctgcattacttgatggattcagatcagtggaaacgttggtgtcccatgcatcaacgtagtagccgtagctggcggtatgtggggcgatggcggaggcatcgagaagcgctggctcctgggcggacgctgcgggaacggtgatgatcgttgatgccagtgcggtgcataggacgaggccaagtggccgggaagaggggcgcatgatgtctttcaaagtgaaggggtcccacagtgcctgttgagtttttatgaaaaaagctggcgctggggccacgaacttaaaggagagggagccttgagaaaagggcccggcggattaagttaggcttcccacgtgtccattaagttaactttgcaatacttgttaattaacttgtaaacatagttttgtggagcgtgttatttctctttaaaaacttgttgtacgttcagcgcacctcaaattagctacaccgatgcaggccacaggtatttcaagatgtgatcccaagttattacaccaagcaccgttttcccatcagcggaaagcaccgcactgatctgctcgttatgctcccgcatgtattccagcgcttggtgtaacgtgtcggtctcagcaacggtgaggattgggcgagaccacttcgaagccttctcgtctggcgaggcaccaagggtgtctcgcacatgaatgacgtgtgggaaaaggtgggagggggcgtcgataagcacacgcaagctgccactgcgctgagctgcggcttgcacctcagcaaccgtggcgctggcgctgtgcgtaaatggagatgcggtcagggtttgaccgaccgtgattttatccagcttgataattccgctgatttgggcggcggattgctgatccagagcgccagtttctcgggaatgctcaatgagggcatggagggtatcggtgtcatagccaccagctgcagctcgatcaacgggagtttcaccaactttgcggaccaaatcgttcgccattttgttgatccactgcagcaatggacgaaacaggttaatgaagccccgtgcgggaatcgcgatagttcgaagtgccgtctccggatgcgcgattgcccaggatttcggagccatttcgccgatgaccaagtgcagaaacgttacgataaacagcgacaaaataaacgcaatgacatctgccataaccagcggtatacgcgcccattcgaagagcggcatcaaagcataatgaacccacggcttcgtgatagcacccaacgcgaaagtcaccatggtgattcccaactgcgcgcccgcgagcatgagagtaagttcattgaggcttcgcaacgcagcgcgggaagaccgcgaggtttccacagtctcctctaaccggttccgcctagctgcaagcaaagcgaactcaatgatgacgaaaaacgcagacagcgcgatgagtagaatagtggcgggtaaaacgacataccattcagtcatggcttagcgattctccttcggagcggggtgattgtctgggtggtcttcgagcagagcgagcgccagttttacaggcacgtttcgctctacctctaaaacagtgatgcgcaaaatacgctgcgtaggggaggtgttgttcaggtaatcctctggctcaaaatccagaggtatttctatgacatccccagtctttagaagggcattcgcatggtcaaagagcagtccagaaatcgtctcgtaatcgccttcaggtagctcgtacccgatggcgcgctcaacctcgtcaagaggggtatcgccatcaattagccatttgtcagggctcgtttccgtaatatcttcagagctgaaaacatcgtgctcatcgttgatatcgccgaggacttcctcagctaaatcttctaatgtcacaatgccaatgaatccaccgtattcatcaatcacgcaagcaagcctgtcttcacgattgtgcagttcggtcaccacgtcaggcaaagacataaactctggaacgatcacaggctgatgcatgaactcagtgactttcgcggaatctgaaatttcggcgccgtgaatatcggttccaagaatatcaatcagattgatcaccccaatgggcacatggttgtcatcgatgatggggtaacgcgtatgcgctttcctcatgagggccttaacctcagcgatggttgtctccggatcaaccacacccacacgcgaacgcggaatcattgcatgacccacatcatgcgacgggaaatccaacaatcgatcaagcgacaaagacatcgaattatttaaaacgccactatccctagatgacgccacaatatgcggaaggtcttgtgcagtggcagacgaatcaacatcttccaccggctctattcgaaagagtcgaagcaatgcgttggatgcaaaatcaaagaatgtgatcaaccaaccagcgagtttcaaataccacgtggtcgaaggcgcaagcgccagcgcagacttcaacggcgtggcaagggtgtagttcttagggaagagttcaccaaaaatcatttggacaaccgtggagatcgctagcgccaacacagtgcccacagagattgacaccgcagcgggaacccccacccctcctagcagaacacctaacgcgttacccaccagaggttcggccacaaaacccaccaaaagtccggtgacggtgatacccaattgcgcaccagaaagcataaaggatgtgcgcttagtgatgctgagagcgcgacgagccttcttatctccagagtcagcgagagctcgcagctcatttcgatcaacggacatgtaggcaaattcctgagccacaaaatatccgttgaggacgatgatcaccccaatgaccaccaaaccagcaattaaagacaaaacagctgttaacaagattccacctgcctcaacacaaatagattagtgtggacaggccagatagatcgtgcgggaggctccatgcggagtctaaacctcattcattcaagtcggtgatgccccgtgttcgggaatatgaaagagtgtacagaaaaagcagagctcacgtttctcatcagtgggctttagggagcgttacgttgcccaatacctccagttcagccaccgtatcgtagtctttttcagtgccatcgccacccacttccacaatgtgtcccgcttgcttcagtaacgcttttgccggtcgatttctagtctcgcccaggctgtgaatcaccgcttctaggctgccacttctccacagcgcgcacaacggttgtacccagccatcggcagcaagggttacggccacatcggctttgccaatctgtgcctgaagtaggggcagcatcgctgcagaataaggcgcgtccacggcaagaatcgcagtgaattcatgggcgtgctcaaaagaattcagccctgcctcgattcccgcgaccggcccgccaagcggaggttcctcgcagacagtcgtgattccgtcgatgatcgcgggggaaaccaccacgacgtcatcttctggatccagctgtgaaagcaggatatccagcagcgtgcgaccatccaccgccacagcagccttatccaccccacccatgcgtttaccctcgccaccagcaagaatgatgatattcatttacattctccccagcacaacatcaaccagaccgtcctcggcaatcgacgaagtcaccagtgcaataccgccacttccagccagtgcaccgaccatatgggatcgatgtgcctgagaatttgccattcttttctcccaatcaatcgccaccggtatcgccaatacggcgccctcccgcgccttcagcgcccggttcgagcgcagcgccaccacagggagttcgcttatcgacgccagcctctttccaccccctaatctctcaattaccggaacaacaaagagcctaaaactaacccacgccgccaccgggtttcccggcagacacaccacttttgcgtcgccccactgcccatgaccttgcggtttacccggcttcatcgcaatggggaagaattcaaaaccaccagtcttagttcccacggctttgaccacatcgaacgcgcccgccgagatcccacccacagtgatgatcacatccgcaacctctgcagccttatcgagcgtctccctcaatgcagtctcagaatcatcggaatggaaatgctgcggatccttaatccccacgcgttttagctccgcaaccagcatcggcccattggaattagggataccccagggatttccctggtttagctcatcaccggtagtgatcaccgcaacccgagggcaaggatgggcttttacagtgtcatggccaactgaaatcaccgtcgacacagtacccgcatcaaatgccgtccccgcagcaaccgcaatttcgccttctttaagatgctcaccagcatggcgaatattattcctctcacctggtagctcattgatcgtgatttctgtaggaagcgagtgatccaccggagcattggtgagctccactggaaccacgatcatgtccttgttggtggatgggacgggtccacctgtcatcacacggatggcttttccattattaatgctcgccggcgcagaacccgccggagtatcaccgcccacaagaaatgtccacggcccgctgccatggatgtcttctttcaaaatggcgtaaccatcaacagcagaattagtaaatttcgggataggaattgtcgcgacaacatcctctgcaaggtgacttaacggatgcgcgccgaggataggggtttttactggcggaagcggtgcgacgctgtctatcaaaatggaaagatagtcatcgacgctgcgttgctgtgccacttgaaacccctttttcgacaataaacactcaaatatatagggtagttgccaaatcaatagttcgcgctgttttaagaggttgagattctcaaacgggtgtttgtatagatcacattgcgatcatgccttagacgcgattctgagagggcaagttttttgagttccggttccaattttaagctcgaccaaaccacagtgcccacgaactggaaattcgacaactctgggcatttgtgtctggtttcaagccgtcgaaaccagaccacgctgcccatgaaccgggaaaacctgagccgtgggcagtgtggtttggtcatggcgttcgaatgctgattcgggccagacaggcgtgacaagattggcgaaaagtctatgattttggcacacctgtccggttatcgggaccaaaaaccagacacacgtgccaaaagctgtggaaattctcgaatcttgtcacgcctgtctggttggggctggtatgggctagccaccgatggcagacatggggcgatctggttggaggaagccttcatcgtcgatgccatggccgggtttcttctcccacatggcgcctgcccacagttgcgcgagctcatcgtcggaggcgccgtcgcgaagcgcgtcacgtaggggagtttcagtgcgggagaaaaggcagtttcggatggtgccgtcggtggtgaggcgggagcgatcgcaatctccgcaaaatgggtgcgtcaccgaggcgatgatgccgatttgtccagtgatatcagggttggatttatctaccacattccacagcgcagcaggtgcagctcctcggggttccttggcgggggataaggtgaatttttcttccaggcgcgccaggatttcttcggctgtgaccatatcgccgcgtttccactgctcgcgcgggccaagtggcatttgttcgatgaatcgcagttgggagcctttggaaatgcagtattccgcaagggggacgatatctacttcattgaccccaggcatgaccacggcgttgatcttcactgggtgaaggccagcggcaacagcggcatcgatggacgccaacacaccggacaatcgatcacgcctggttagcgagacgtagcgttcggcgtcgatggtgtcgagtgaaatattgacccggtcaagaccagcttctttcagtcctgcgatgcgtttgtctaggccaaggccgttggtggtgagagcgatgtgaactttttcgccttcgtcggtgcgcagggctgcggtgccggcgatgatgtcttccaaatttttccgcagtaaaggctcgccgccggtgaatcgaatttgacgaatgcccagcttaaccaccgcaatgcggatgagtcgcagcacctcggcgtcgttaagcgtctgctcggtgggcagccactctaaaccctccgcgggcatgcaataggtgcagcggaggttgcatcggtcggtcagtgacacccgcaggtcacgcgcgatgcgtccgaatctgtccacaagcacgcgattgccgtctgcgggtggcaggtacgcatcatgtttgatgctcgcagaagtgcttttcgacgccccctcccgatcatttcggggcggcgttggcgaaagataaaggcgagtagtcatcttcttgcccatcctagaaagagctgcggaataaagccagtaaaagccggaataaatagggaagttatttttcacctggccctttaagcttaattacttcgaaatcgccgttgcgcaggtggttgcggaggtccttcttgtcatatttaccgacggaggttttatccacctcatcaacaaatgtccaatattctggcagcatccagttgggtaggcggtcgcgaagttgatcgcggaggcgctcggcggtttcccgggtgcgttcaatgccggggtagagcatggtgactgcgaggggacgttccacccacttgtcatcggggaagccaatgacggcgcattcgacaacctcttccgtagccacgatgaggttttccagctgagcggagtaaatccactcgccgccagaacggatgacatcgcgggcgcggtcttggatggtgaggaatccatcgctggtgacagatccaacgtccccggtgcgcagccagccgtcggcggtgaagagctcatcgttttcctcttcaacgtcatggtcgcggaatgttgaggcggtgccaccttctttttccacatcggggtggaagtaacttgcagtcacccacggaccgcggacctgaatctcgccctcgttgcggtcggtggacgccatgacctggccgtcgttgacaatgcggtactgcagggaggcggggaatcggccctgggagactcgataattccaccggctttcaccagaaacacctgatggtgggcgagacacagtacccacggtggaggtttccgtcataccccacacgtggacaacatccacgccatagcgctgctcccacatggtgatcacgattggaggcaccgcagaaccgcccacgtatagctcacgcagagacatacgctctgggggatttttcaggtagtgaaccatcagctgaatccagagagtaggcacgccatgcgccacgcgaggcagcgtggtggaaatgatctttgccaatgtcggcgcagaaagatccggtccaggaagcaccaggggagtgccggacataaacgctgcgatcggcacgccccagctgaggacgtggtaaatcggcacacagcacaggaacgtttcgccgtgttccactgcgagggaatccgtggtgcgcaagctcaacgactgtaaataaagcgagcggtgggaatacaccacacccttcggcggtcccgatgtaccggtggaatagcaaattgcagcagcagtgcgttcatcctgctcgggccagttgtaaacagtggaacggccgtcaaggagcgcttcataggaatacagcttcattccctccggcatgtgggccgccgcgctagagaaatcattcggtccaataaacaccacggcacgaacttttggtgtttcttttaagatctcacccaattgttcagccatgcgcggatcagcgataaccacttcagcttcagagtgattgagaatgaacacaatctgatcattcatcaactgcttgttcagcggattaaacacggcacccatgcatgcgactgcaaacatagtttccatgtgttccgcgcagttatagagcatcgacgccactcgctgatccccagtaatacctaaagaatcatgcagcgcatgagccaaagccgcagctctagcccccacagcactaaaagtttgctgtgcttgttcaatgccatcggcaccgccccacgtggtgatcaaagtatcaccgtgaacagtggacccgtactcgaggattctggttaatgacagtgggacgtcctgcatcgtgctgagcatgcaatcaacaatagccggggcatgcgacacgcaacgacagtgcaagcaatcaactttgaaaacgtcgaaactttatgcagcttttagcgaggggaatgagacatagggcaataccatgcgctagaattatcgaccaaggccgggaacagcttcccggtgcacacaaattcccaggcaaaacgcacaaattagcgtgcagcggaagcaatagaaaattccgtgtgactgagaattgctgaaggggcacccggagggtgtgaaacttaaaacccattagtttttaagatcacatctcggcctggaagaaaacacacagttgcgcggttcctgcgttacaggtgagtcaacttctaatatttgtgtcatcctgcgcgatcgctttcaacgtgcgtagacaactcgcatgtgcgaccaccatttgggtgccacgttcaattacacagaagccgagttcagccatatttttcgcccgtcatatgaaaaacgggtacatcaccgcagcttggtctgaactgcaatgaaaggaaatctgtgacaaccacagacaacaccgcagcgaatcagggtgaactgaccgccctccgactgccggatctgcgcaaaattgccgccgaccttgggctcaagggaacctcggcattgcgtaagggcgatctgatcaacgccatctctgcagcccgcgagggtaagccaaccgcagctgcgaagaagacttccccacgcaaggccccatcacgcacccgtgcgacacagccttccgcaccggttgagcaagcacaagaagctcccgcgcaaacttcaactgcacctgcttcagcaccatctgaagagactcccgcagctcccgctcgtcgtggacgtcgccgtgtaaccaccaccgcgaccaccccagagccagcagcgcctgcacaatcccagcctgcagaagctcaaccagcacagactcaggctgcacagcaagaagaacttcctgttgcagcgaaggagtccgcaccagctacagaaaacactcagggccaagctcagggccaagctcagggccaagctcagggcgatgagcacgatgatcgttttgagtcccgttctgctgcacgccgagcacgccgcaaccgtcagcgccagatccaccgcgatggcgatgacaatgcgaatgcaaacacagagtctgagcagaacacccctgcccagaacgcaaccgcacaggctgagtctgagcagactgcagctcctgcacaggctgaagcagctgagcagaaccagaacgataacagcgagtcctccgagaaccgcagcgataactaccgcaacaacaatcgtcgttcccgcaacaaccggaacaatcgcaattaccgcgataacaacgagtcctctgataatgcaggacagtccagcaatgatgatgccgacaacaatcaggcacggtctgaggacaataacgacgatcgccgttctcgtaataaccgtaacaacgaccgcaatgatcgtaacgatcgcaatgaccgcgacaacgacgacaacgatgatcgccgcaaccgtcgcggacgccgcaatcgccgtggacgcaacgaccgtaacgatcgcgacaaccgagataaccgggataaccgcgacaacagcaacgatggcgacaacaaccagcaagatgagctgcagcaggtagcaggcatcctggacatcgtggaccataacgtcgcattcgtgcgcaccaccggttaccacgctgcaccttctgacgtgtttgtcagcaaccagctgatccgccgtatgggtcttcgttccggtgacgccattgaaggtcaggttcgtatgaaccagggtggtggcaaccacaacaaccatggtcgcaaccgtcagaagtacaacaacttggtgcgcgtggagatggttaacggtcttcctgctgaagagactcgcaaccgtcctgagttcggcaagctgactcctctgtacccgaaccagcgtctgcgtttggaaactgagcagaagattcttaccactcgtgtgatcgacttgatcatgcctattggtaagggacagcgtgctttgattgtgtcgccacctaaggctggtaagaccacgatcctgcagaacattgcgaacgctatttccaccaacaacccagagtgctacctcatggttgttttggttgatgagcgtccggaagaagttactgatatgcagcgctccgtcaacggcgaagtgatttcttctactttcgatcgtccaccatcagagcacactgcggttgctgagctggcgattgagcgtgcgaagcgcctggtggagcagggccaggacgtcgttgttctgcttgactccattactcgtttgggccgtgcgtacaacaacagctcacctgcatcgggacgtattttgtccggtggtgtggattccaatgcactgtacccgccgaagcgtttcttgggtgctgctcgaaacatcgaaaatggtggatctttgaccatcatcgcaactgccatggtggaaaccggctctgctggtgacaccgtgatcttcgaggagttcaagggcactggtaacgctgagctgaagctggatcgtaagatctctgagcgccgcgttttcccagctgtggatgttaatccttctggtactcgtaaggacgagctgttgctcaacccggacgaggctcgcattatgcacaagctgcgtcgtattctgtctgcacttgataatcagcaagccattgatctgttgatcaagcagctgaagaagaccaagtccaatgcggaattcctcatgcaggttgcttccagcgctccaatggcaggcacagaaaaagaggaggattactcctaatggcatcgcaggtttctgcagttgacgatattttgtcggagtaccacggtctggaacagcagatggctgatccggagttgcacaatgatgcggcagcagcgcgccgggtaggtaagcgctactcggagttgcagccgatcattaacgtgcaccgtgatttggtgtctgcccaggaagatcttgaggcagcccgtgaaatggcacatgaggaccatgagttccaggccgaggctgagcgccttgaggtggaagttgtggagttggaagaaaagctcgctgatcttcttgcacctcgtgatcctcatgatggcgaagacatcgtgatggaaatcaaggctggcgcaggcggcgaagaggcagcgttgttcgctggcgatttgttgcgcatgtaccaaaagtttgcggataagcacggctttgtcgtggaggttttggactctgcagaatctgacctcggtggtgtcaaggacatcaccttgtctattcgttcccgtcagccatcccgcgatggtgcgtggagccagttcaagtttgaaggtggcgtgcaccgtgttcagcgtgtgcctgttactgaatctcagggacgcatccagacctctgctgctggtgtcttggtttacccagaaccagatgaggtggaaaacgttgagatcgatgagaaggatattcgcgtcgatgtgtaccgttcctcaggtaagggtggtcagggcgttaacaccactgactccgctgtgcgtattacccacttgccaactggtttggtggtgacctgtcagaaggagcgctcccagattcagaaccgtgcgcgtgcgatgcaggttttggctgcccgtttacaggcgatgaaggaagaggaagcggcggctgaggctgctacgggacgtgctgcgcagattcgcaccatggaccgctctgagcgcatccgtacctacaactggccggaaaaccgcatcagcgatcaccgtattggttttaaggcgaacaaccttgattcggttctcgatggtgaattggatgatctgttcaccgcgttgcaggctgctgagcgtgcagaacgtcttgaggccgagggctaaatgctgacccttggggaagctttgcgcgacgccaccgccaccctggaaagggcgggggtggcgtcgccacttgtggacgctcgtttgattgcggctcatttgctgggttgcggtccgctcgatattgcattgcgcatgcgtgatgaggtgccggctgggtttgcggcggcggttgagcgtcgtgcgcgacgcgaaccgctgcagcacatcttgggcacggcacccatgggcccgttggatttgcatgtgggaccgggcgtgttcattccgcgcccggaaaccgaggtgctcgcggactgggccgtgcggcaggtggctggcgacgtcgaaaagcgaaaaatcgttgacctgtgcaccggatccggcgcgcttgcggcctacatcgggcatgcgcttatcgacgcgaccctctacgctgtcgaactcgatccgggggcagcgacctgggcgcagcgaaactttgatgaatttgccccgcaggtgaagctcatccacggtgatgtaacagatccgacattgttggctgaggtgcatggcacgatcgatctcgttgtgtcaaatccgccgtatgtgcctgaatctgatgatttggatccagaggtctaccaagatccacacatggcggtatttagtggcgctgatggcatggatgtcatcaacaagatggtgcacctgatcttcaatttgctgaaatctggtggggcagtgggcatcgaacatgatgacaccacttctgacgccgtccgccaagttttttctcagcacgggggatttggcactattgaagtgcttcatgatctcaccggcagagcgcgttttgttacagcgcgtaaactgtgactttgaaaaatttttgaacaatccgtacaccaacttcaggagaaaaacagtgagcagaatctatgactgtgccgaccaagactcccgtgcagcaggcctaaaggcggctgtcgatgcagtcaaagccggtcagctcgttgtccttcccacggataccctttatggactcggctgcgacgctttcaacaacgaggcagtagccaaccttctggccaccaaacaccgtggccccgatatgcccgttccagtgctcgtcggcagctgggacaccattcaaggacttgtgcactcctattctgcgcaggcaaaagcgcttgtggaggcgttctggcctggtggactgtccatcatcgttccgcaggcaccaagccttccgtggaaccttggcgatacccgtggcaccgtaatgctgcgcatgccactgcacccagttgccattgaattgctgcgccaaaccggaccaatggctgtctcctccgccaacatctccggacatactcctccaaccaccgtgctggaggctcgtcagcagctcaaccaaaatgtcgctgtctacctcgatggtggcgaatgcgcgctggccaccccttcaaccatcgtggatatttcaggccccgcaccaaagattttgcgtgagggtgccatcagcgcagaacgcgttggcgaagtacttggagtgtcggcagaaagcctgcgctaaatgggagtcggtttcgcgggaatcccgctgcgcgaattgggattggttatcctcgttgcagcggccatcacgtatctcagcacgggcatcatccgcaccgtcatggtgaaaagtggtcgcctcaatgagattcgtgaacgagacgtccatgtcatccccaaaccacggcttggtggcgtggcgatgttcagtggatttctcggcgcagtattccttgcggaccagcttcccgccttgactcgcgggttcatgcccatcaccccggagatgaatgccgtcatttgggcaggctttgtcatcgtggtggtgggcgcactggatgacctttttgatcttgatgccatcactaaattggtgggtcaagtaattggtgcggtgactatgagtttgcttggtctcacgtggtccatcctctatgttcccttcggtgggggcaccacattgcttctcgaccaagtccagtcaacaatcttgacatccctgttcaccgtggcgttgattaatgctctgaacttcgttgacggtcttgacggcttgagtgccggcgtaggaatgatcgcgggtgcagccatcctgctgttctccctgacgattctcttcgaccaaaacggcgccgtatcggcctatccgccggccatcatcgcagcggctctcgtaggaatttgcgcgggagttttgccccataattttgaaccctcgcgaatatttatgggcgattccggctccatgctcatcggcctgctgttggctgcagcatcgacctcagcgtcaggaaaaatcaacatgagcctgtatggcgcagctgattttatcgcattgatctcacccatcatcgttgttctcgccgccgtggccatcccactgctcgacctcgtgatggcagtggttaggcgcgtgggcaggggagcatcacccttttccccggacaaaatgcatctgcaccaccgactgctgtccatcggacacacccataggcgcgtggtcctagtgctctacacctgggcgagcgccgtggcattcggcgcagtgagcttctccgtcgttccgccactgtttgccaccggatcgagcatctgtggcatcctcatcgccgtcgctgtcacagccgtgccagtgatgaaaagccggcgagccgccaaacttgattaagtgattgtcactttggattgtcatattgggcgaataaaccggtaggattccccttcgtgagcgccgaaaataccgagaacacagattccccatttgaaatctccgagtttgatgatcaccgacgccccctccagcgggccctcaaattcggttccatcgccctaattgtcttcaccctgatctccctagcgatctggggtgctactcgcggcgtacccggcgtatggggagttgttatcggcgcagcagttggcggaggctttgtcctcttaacggctctcagcgtcctgtttacagctaattccaacgtcaccaccaccggtgcggtggtgctcggtggctggctgctgaagatcgttattctgatcatcgtgcttgcagtcatcaaagacatgaccttctacgacaacaccgccctttttgtcacagtggtgattgccttagtagttgtcctgctgactgaagtctggggagtcgtgacctctagggttacatacgtcggataagcaatcggtcatttcaacgcccccacaccccttgaaacaggggagtgggggcgttttaatacctgcccccgctacccattgttgactaggtgagtgggcttaggtgtctcagagcacagtagtcggacattagagagctgcaccgcagtaaaaggccacgatgtaggaggtgggcggagtgtccgtgctgggaaactggcggggaacttttagagataaccctccgaattgctggcaaatttctgatgaaatttctccgcgaagcccacatgaactacccccgtttaccctcaaaataagccctgtgacacacataacaccccctaatcgtacccgctcacacgctattttcgaggtgtggttcgccttcggaaacgaatgcccccgccccacttggataaaagacgaattcacctgttagtctataacgcgggttgaaccgagaaacccctcaaggcagcagacaatagccgcaaggggttttgcggagcacgtcccctgtgatcgttgcgctgatgtgcgacggagtccgtagcgattacagcgagtttttcagacgtccatcgcaccgtgcacaacaacatttcaggtgcacggcccgaacacgggagagaacgctgagcgttacaacactgtccatgaagggcgaattccacgcccccgatttggacaaagaatttttcccggggcacgtaaccgatagtggtgaagtcgtgaacatgctgttcaccgatttcgctaatggttggttcgcaatggaccgcatcgtattgatccgtcttcttatgacggcagtcgttgtggtcttcttcctttgggctatgcgcaagccaaagcttgttccgcatggcgtccagaattttgcagagtacgcactcgatttcgttcgtattcacatcgctgaagacatcctcggaaagaaggaaggtcgtcggttcctgccgatcctggccaccatcttcttcgcggctctgttgatgaaccttgcaacgatcatcccgggactaaacatctcctccaactcacgtattgcattcccaatcgtgatggcggtagctggttacatcgcgtttatctacgcaggctctaagcgttacggattcttcaaatatgtgaagtcttctgttgtgattccgaacattccaccagcacttcacgtcttggtggttccaattgagttcttctctacattcatcttgaggccagtcaccctggcactgcgtttgatggccaacttccttgctggccacatcatcctggttctgcttttctccgcaacgaacttcttcttcttccagttcaacggatggacagcaatgtccggcgtaaccatcttgatggcagtactcttcacggtttacgagatcattgttatcttcctgcaggcatacatcttcgctctgctggtcgctgtatacattgagctttcacttcacgcggattctcactagatgaaaaaggtcgctattaaaagcttcttgcacaagtcgcccagatagcgagcggaccactcggtcaactgaataaccccactaaacacttcacagcccgaacacacgggcaccagaaagggaacgacacctcatgaacgagatcatcctggcacaggacgcaaccgagtccaccatcaccggacttggcgctgtcggctacggcatcgcaaccatcggacctggcctcggcatcggcatcctggttggtaaggctctcgagggtatggcacgtcagcctgagatggctggacagctccgtaccaccatgttcctgggcatcgccttcgttgaggccctggcactgatcggccttgttgctggcttcctgttctaatcagctaacttaaccgaaagctggtaaaccatggcgaattcgatttacaatttggcgcaagcagatgcgctgcctttggagagcggaaactcaattctgttccctcctctgtatgacatcgtctggtccctcatcccgtttttgatcatcctgatcgtattttggaagcttgttcttccgaagttccaggaggtcctgaccgagcgtgaggaccggatcaagggaggcattcagcgtgccgaagccgctcaggctgaggccaaggctgcccttgaaaagtacaacgcacagctcgctgaggcccgtactgaagctgctgagatccgtgagcaggcgcgcgagcgcggcaagcagatcgaagcagaactgaaggacaaggctaacgaagagagcaaccgcatcatcgagtccggtagcaagcagcttctggcacagcgcgagcaggtcgttaacgaactgcgccgcgaaatgggccagaactccatcaaccttgccgagcaccttcttggagatcagctctccgataacgtgaagcgctctggcacgattgatcgcttcctcgctgacctcgataccgtggcaccgaacggaaagtaggcgacatgcacgcagcaagccgcgaggcactggcaaaggtttcgtccgatctggacgctgctctagcagcagacaacaccatggcagttgccgcccaggctggaactgagcttttcgacgtcgtcgacattctcgacggcgaccgagctctgcgtgttgctgttgccgactcttctaaggacgcacacagccgagtcggcctcattgaggctgtcttcggtggaaaagtgagcccatctgttctcgaagtcctcaaggacgccgcagagcagacctggtccactccacgcgagttccgcgctggactagtccaacttggccgtcgcgcccttcttcgctctgcggagaaacagggtcagcttggtcaggtggaagatgaactgttccgactcagccgaatcctggatcgcgaaagcaagctgactcagcttctttcagatcgcactcaggaaattggcggtcgacgtgacctcctggctaaggtgctctacggcaaggtaactgctgttaccgaagccctcgcactgcaggctattggtcgccctgagcacaacccaattgacgatatcgcagctttggctggcgctgtagcagagctacagggtcgttccgttgcacatgtcgttaccgcagttgaactcaacgagggacagcaacaagcgctagctgaaaagctgggacgtatttatggtcgtgcgatgagcatccactccgaggttgataccagcctcctcggtggaatgatcatccgcgtcggagacgaagtaattgacggcagcacctcgggcaaactcgagcgtctgcgggcaagcttcgcataaagacacgacgaattagacaacattagtaatgctggaagaaacaaccgagagcaggaagaacatggcggagctgacgatctcctccgatgagatccgtagcgcgattgcgaactacacctcgagctactccgcggaggcctcccgtgaggaggtcggcgtggttatttcggccgctgacggtatcgcccaggtttcgggcctcccgtcagtaatggcgaatgagctcctcgaattcccgggcggcgtcatcggcgtcgcacagaaccttgaagctgaccgagtcggcgtcgtggtcctgggtaactacgagctacttaaagaaggcgaccaagttcgtcgtactggagacgttctgtctatcccagtcggcgaggcattccttggccgcgttatcaacccccttggccagccaattgacggcctgggcgaaattgcatccgaagaggaccgcgtcctcgagcttcaggcaccaaccgtgcttgagcgccagcctgtcgaggagcctttggcaaccggcatcaaggctatcgatgcaatgaccccaatcggccgcggtcagcgtcagctgatcattggtgaccgtaagactggcaagaccgcagtctgtgtcgataccatccttaaccagaaggccaactgggagaccggcgacaagaccaagcaggttcgctgcatctacgtcgcaatcggtcagaagggctccaccattgcagccctgcgtaagaccctcgaggagcagggcgctctcgagtacaccaccatcgtggctgcacccgcttccgatgctgcaggcttcaagtggcttgcaccattcgctggcgctgctctcgcccagcactggatgtaccagggcaaccacgtcctggtcatctacgatgatctgaccaagcaggctgaggcataccgtgctatctccctgctgctgcgtcgcccaccgggccgcgaagcatacccaggtgacgtcttctacctgcactcccgtctgctggagcgcgctgcgaagctgtccgatgaactaggcgcaggttctattacagcactgccaatcattgagaccaaggctaatgacgtttccgccttcattcctaccaacgtgatttccatcaccgacggtcaggtattccttgagtccgacctgttcaaccgtggcgttcgcccggcgatcaacgtcggtgtatccgtctcccgtgtcggtggcgcagctcagaccaagggtatgaagaaggttgccggttctctccgtctggatctggctgcattccgcgacctggaagcattcgctaccttcgcatctgacttggatgctgcatccaagtctcagcttgagcgtggccagcgcctcgttcagctgttgattcagtctgagaacgcacctcaggctgttgagtaccagatcatttctctctggcttgcaggcgaaggcgcattcgacaacgttcctgttgaagatgttcgtcgcttcgagtccgaactgcacgagtacttaggctccaacgctgcacaggtctacgagcagatcgctggtggagctcagctttccgacgagtccaaggaaaccttgctcaaggcaaccgaagatttcaagagcgctttccagaccaccgatggcacccctgtcatcaacgagcctgaggttgaagcactcgatgcaggccaggtcaagaaagaccagctcaccgtttcccgcaaggtcagcaagaagtaaggcagcgagcctacactaaatgactgtccaagcaactgaagggaggcgtgtgaaccatggcaacaattcgtgaattgcgtgaccgaattcgttcggttaactcaaccaagaagatcaccaaggctcaagagctcatcgccacctctcgcatcaccaaggcacagggtcgcgtcgcggcagctgcgccgtacgccgaggaaatccagcgcgtgctggagcgcctcgcgtcggcaagctccctagaccacccaatgctgcgtgagcgtgaaggcggcaagcgagccgccgtgctcgtggttacttctgaccgcggcatggctggtggctacaaccacaacgttctgaaaaaggcagcggagctggaaaagcttcttgctgaaagtggatacgaagtggttcgttatgtcaccggcaaaaagggcgtcgactactacaagttccgcgctgaagatgtggctggcacctggactggattctcacaggatccagactgggcagctacccacaacgtgcgccgtcacctcattgatggtttcaccgccagctctgaaggtgaagctgcatggcgcgagggactgaacctaccagaaggccaggatatccagggcttcgaccaggttcacgtggtctacaccgagttcatctccatgctgactcaaaacccagtagtgcaccaactgctgcctgttgagccagtcatcgaagatgaaattttcgaaaaaggcgaggatctgctgtcctcttccggcgaagtcgaacccgactacgagttcgagccggatgcagacactctgcttgaggcactgcttccgcagtacgtctctcgtaggctgttctccatcttcttggaggctgcagctgcagagtccgcttcacgtcgaaacgcgatgaagtctgcgactgacaacgctacggaactggtcaaggacctgtcccgtgtggccaaccaggcacgtcaggcacagatcacccaggaaatcacagagattgttggtggcgcaggcgcgctcgccgacagcggagaaagtgactaattatgactacagctcttgaagagcagaacgcacagcaggcagccactgccggccgtgtcgtgcgtgtcattggtgcggtcgtcgacgtggagtttccccgcggcgagctgccagcactgtacaacgcacttactgtagaggtaaccctcgaatcagttaagaagaccgttgttctcgaggttgctcagcacctcggcgacaacctcatccgcaccatcgctatggcaccaaccgacggacttgtccgcggtgctgctgtaaccgatactgcacgcccaatttccgtaccagtgggcgatgttgttaagggccacgtattcaacgctttgggcgactgcctagacgacgtttccctgaacaacaacccagagatcgagcgttggggcatccaccgcgagccaccatcattcgatcagcttgagggtaagaccgagatcctggaaacaggcatcaaggttatcgaccttctcaccccttacgttaagggtggaaagatcggcctcttcggtggtgcaggtgtgggtaagaccgttcttatccaggaaatgatcacccgtattgcacgtgagttctccggtacttccgtgttcgcaggtgttggtgagcgtacccgtgagggcaccgacctcttcctcgaaatggaagaaatgggcgttctccaggacaccgccctggtgttcggtcagatggatgagccaccaggagtccgtatgcgcgtggctctgtccggcctgaccatggcggagtacttccgcgatgttcagaaccaggacgtgctgctgttcatcgacaacatcttccgtttcacccaggcaggttctgaggtttccacccttctgggtcgtatgccttccgccgtgggttaccagccaaccctggctgacgagatgggtgttctccaggagcgcattacctccaccaagggccgttcgattacctctctgcaggccgtttacgttcctgccgatgactacaccgacccggctccagcgaccaccttcgctcacttggatgcaaccaccgagcttgaccgctccattgcttccaagggtatttacccagcagtgaacccactgacctccacctctcgtattctcgagccagcaatcgttggtgagcgtcactacgaggtttctcagcgtgtcatcggcattctgcagaagaacaaggaacttcaggacatcatcgccatccttggtatggacgagctttctgaagaggacaagatcaccgttgcacgtgcgcgtcgcatcgagcgcttcctgggtcagaacttcttcgttgcagagaagttcaccggtcttcctggctcctacgtgccactgaccgacaccgtcgacgctttcgagcgtatttgcaacggcgacttcgaccactacccagatcaggctttcaacggcctcggtggtttggacgatgtcgaagctgcatacaagaagctgaccggaaagtaaggtagagacacatggctgaaatcaccgttgaactggtgtctgtagagcgcatgctgtgggccggccaggcctccatcgtgactgcacagaccaccgagggtgagatcggcgtgctgcccgatcacgagcctcttctcggccaattggttgagaacggtgtcgtgaccatccagccgatcgacggcgaaaagcttatcgccggcgtttcggatggattcctctccgtatctaaggaaaaggtgacgatcctcgcggacttcgccgtctgggcgaatgaggttgataccgcatccgccgaggctgaccttaattcggacgacgagctggccaaggcacacgccgaggctgggctgcgcgcggtccgccgcagcagcgaaggtctctaaacctccgtttagctgaagtagtaaaacccgctgatatttctaaatgaagtatcagcgggttttggtatttctgggtgtcgcattagccccgctgtgggggtgatttattgggagtacctagggtcctgacaacctatgatccttgacctcggcaggatcaacgacggcggtttcgcgccaggcgacattgtgagtaggatcgtctaaaatcgttttcttatcgcaggaaggactcaaaaaggccgtggaatatttgacctggggtttggtgattgttgcagtgtcggcagttcttcttgctgcctggcggtttttcaccttacgttctcggggaaccactgtgattctgcgtgagttgccacaaagcggtgtgcatggctggcgccatggatcatttcgctacaacggcaacgacttggagtacttcaagctgcgctctttgtctcccatggctgaccttattttgaaccgcctttcagtaactttgcttgatcgtagagatccagctgctgatgaggcggtttttatgtctcaaggcttaaaaattctgcacattaaatccaaaaatgatcagattgaattagctttggacgcccacggggagatggcgtttactgcctggttggaagcagcaccagatgcgcgggcggagcattcattgaatccacgtgatttcaaccgctttcgagccagcaaagacacccgcaaaaaccgctaagtagacgtcattgttatggtgggtgcatgcgtttagtcatcgcccgttgctcagttgattatgttggccgtttggaagctcatcttccgtccgccgatcgccttttgatggttaaggcggatggttctgtatccatccatgccgatgaccgtgcctataagccactgaactggatgacacctccatgttctttagttgaaactcccatcactgatgaagatggtgaagcaacaggggaaagcctgtgggtggtggaaaacaaaaagggcgagcagcttcgaattactgtggaagaaattcattcggaacaaaacttcgatctaggccaagacccaggtttggtgaaagacggagtggaagatcatctccaagagcttcttgcagagcacatcactacgttgggtgatgggtacacattgattcgtcgggagtatccaacagctattgggcctgtcgatattttgtgtcgcaactctgacggcgagactgtcgctgtggagatcaagcgtcgtggtggcatcgacggcgttgagcagttgaccaggtatttggaattgctcaaccgtgatgaattgctcaagcctgttcatggagtgtttgcagcccaggagattaagcctcaggcaaagactctcgcggaggatcgtggcatcaagtgcgtgacgttggattatcaagcgcttcgtggcattgagtccaatgagctgacattgttctaagaacatgggccgaaaaaatagaagaaccaatattcagccagctagggacctgccggtcgatggtacctcctattggggaactcaaactcaggagggccctagctggacgtttggtgagccgtatttggtgagacagattggttcatcggcggcgaagaagttttatatttgccccggatgtaaccagaacattccgccgggtgtagctcatatcgtggcgtggccgaaggaagccggcgggcgcgctgatgatcgccgacactggcacaaaccttgctgggagcgtcgataagcaattagctttgaggctgcgtgatctcgagcagcacgccgcccgcgtctttggggtgcaggaagttgatgcgggcaccgccggtgccgtttttgggttcggggtagagcaggcgcacgccttggcggcgcaggtgctcggagagcgcatcgatgttgttggtgcgcaggcacatttgctggatgccgggacctttcttttcgaggaatttggcgattgtggagtcctcgttgagcggcgcgatgagctgaatcatgccttctgtgcttttaatgtctttggggccgatcatggcctctgaaatgccttgttcctcattgatttcttggtggtggtttacccagccgaatgcggaacggtaaaattcgatggcttcctcgaggtcagggacggcgatgccaacatgatcgaggcagatgacgtattcgtgggggatattcaaagactgttcggtagacatggcttaattttaggcatagcaggtgggggaatattgaggattgggcaagctagtcatcacatgccaaccccaaggtagggtggcagatatgattgttgctttttctgtagccccgactgttactgataatccagatgctgagatggccgatgcggtcacggaggcgattcgaatcgtccgcgcatcgggtctgcctaatgaaactaacgcgatgttcacgctcattgagggggagtgggatgaggtgatggcggtgattaaggaggccactgaggcgatctctagggtatctccgcgtacatcgttggtaattaaggctgatattcgtccgggacacactggccaattgacgaggaaggtggaggcggtggaggaacgcctagctagggattagctttgtacttaaacttgttgtttttaagtggatttccacaaagtgttagaaaaagtcattcgagaagaaggcgtgagttttaatcgtgacgtccccgcataattttgtcagtggtgctattgatctgggtgaggtgaaagcgcgtgcggatgcgcgccagaaggcccatgagcaggggccggtaactcagggcattgctagttcccttgatgtgaccatggagaacctggagaatgaggtgctgcgtcgttccacgcaggttccggtgattgttctcgtgggtaccccgcgcagccctgattcggagcagttgaagtcggatctgaccacgcttgctgctgaaagtggcaggaagttcattttcggttatgtcaatgctgataccgatgctgatgtggcccaggtgtttggggtgcagggcttgccgtcggtgattgctgtggcagcgggacgccctctggctgatttccagggcggacagccagcggatgcactaaagcagtggactgatcaggtggttcaggctgtgggtggacagctggaaggactgccagaggaggccacagacggcgaacaagaagacgctcctgtggaagacccccgcttcgatgctgccactgatgctctaaaccgtggcgctttcgatgaggcgattgcggtttatgagtccattttggcgcaggagccaaacaacgctgatgcgaagcaggcacgcgataccgcaaagctgttgggccggcttgccacggtggatccttcggtggatgttgtcgctgctgcagatgctgatccaacaaacgttgatctggcctacacagcagctgacgcggctgttgttgcgggtgatcctgaggctgcctttgatcgtttaattgctctgctgaccatcagcgctggcgatcagaagaatcaggtgaaggaacgtttgctggagctgtttggcatgtttgagaccgccgatccccgtgtgctgcaggcgcgaggaaagatggccagcgcgctgttctaaaaccactctctatccagaaaaatatagaccgcttagtcttttccaggactaagtggtctacatttttacccaaaatgcagctcacgcaatagacatctcggtctatatacttgccaccttcgcgccctgcaaatccccacactacttatatccagcccgaaaataatacttctctctagacgaagcggtctgtttaagtatgtgccatgacattaactttccattggttcctatccacttcaggcgattcccgcggcatcatcggcggcggtcacggtgcagaaaaatccggcacctcccgcgaattgagccacagctacctcaagcagttggcgctagctgccgagaccaacggttttgaatctgtcctgacaccaacgggcacgtggtgcgaagatgcgtggattactgacgcttctttgattgaggcgacaaaacgcttgaagttcctcgttgcgcttcgccctgggcagattggacctacgctgtctgctcaaatggcttctactttccagcgtctgtctggcaaccgtttgctgatcaatgtggtcaccggtggggaagatgcggagcagcgtgcgtttggtgatttcttgaacaaggaggagcgctacgcccgtaccggagaattcttggatatcgtgagccgcttgtggcgaggcgaaaccgtcacgcaccacggtgaacacctgcaggtggagcaagctagccttgcgcatccgccagagattattccggagattctttttggtggatcgtcgccagctgcaggtgaggtggctgcacgttatgcggacacctatctcacgtggggtgaaactcccgatcaggtggcgcagaaaatcaactggatcaacgagctagcagcacagcgcggccgggaactgcgccatggaatccgcttccatgtgatcacccgcgatacgtctgaagaagcatgggtggtggcagagaagttgattagcggggtcactccagaacaggtcgctaaggctcaagccgggtttgcaacgtctaagtcggaggggcagcgccggatggctgagctgcacagcaagggtcgtgcctttactagtggctcaactgctcgtgatctggaggtgtatcccaatgtgtgggcaggcgtcggtttgcttcgcggaggtgcaggaacagcccttgtgggctcgcatgaagaggtcgccgatcgcatcgaagaatacgcagcactcggcttggatcagtttgtactgtcgggttatccaaacttggaggaggccttccacttcggtgagggtgtgattccggagctgctgcgccgcggtgtggatatcaaaaatcaagaatcacgagttttggaacctgttgggtaaacgggaagaacgagacgtcgataagcaaatttcttaaggaacctgacatgactacaaccttgactcgccccaaaatcgcgctgcccgcgcgcatctattcaccgcttgcggtgcttgttttctggcagctcggctcgagcctgggcgccatcccggagcggattctgccggcaccaaccacgatcttggccgccagctgggaggtcgccacaaatggcacgcttctcgacgccctcctcgtctcaagccaacgcgtccttctaggcttcgccctcggtgctgtcctaggcatttccctaggtgtattgacaggcatgtccagatttgcagacaccgccgttgatccgctcattcaagctgcccgcgcgctgcctcacctgggtcttgtgccgctgtttatcatctggttcggtatcggtgagctgccgaaagtactgattattagcctcggcgtgctgtatccgctgtacctcaacaccgccagcgggttcaggcaaattgatccaaagcttctggaagccggccacgtgatgggcttcggatttttccagaggttgcggaccatcatcattccttctgccgcgccgcaactttttgtcggcctgcgccaagcaagtgcggccgcctggctctcactgatcgtggcggaacaggtcaacgcccgcgaaggactcggcttcctcatcaacaatgcgcgcgatttttaccgcaccgacctcgttattttcggcctcattgtctacgccagcctcggtctgctgtctgaagcgctgatcagagcttgggaacgtcacaccttccgctaccgaaacgcataagaaagttgctcgccatgactgccacattgtcactcaaacccgcagccactgtccgtggattgcgcaaatcatacggaactaaagaagtcctccaaggaatcgacctcaccatcaactgcggcgaagtaaccgcgctgatcggacgctcaggttcaggaaaatccaccatcctgcgcgtgttggcgggcctatctaaagagcattccggctctgtagaaatttccggaaacccggccgttgccttccaagagcctcgcctgttgccgtggaaaacggtgctcgataatgtgacctttggcctcaaccgcactgatatttcctggtcagaagcacaagaacgcgcctcggcactgcttgcagaagtcaaacttcccgactccgacgccgcctggcccctcacgctctccggcggccaagcccagcgcgtctcccttgcgcgagcgctcatctccgagccagagcttttgcttctcgacgaacccttcggcgccctcgatgctctgacaagactgacagcccaagacctgctgctcaaaaccgtgaacacccgaaacttgggagttctgctggtcacccatgatgtttccgaggccatcgccctggccgaccacgtccttcttcttgacgacggcgccatcacacacagtttgactgtagatatccccggcgatcgccgcacccacccctcctttgcctcctacaccgctcaactccttgagtggctcgaaatcaccacacctgcctagaaagaaatcatgaaatttaagaaaatcgccctcgttctcgccttcggtctaggccttgcatcctgctcatcagcttctggcgatcccgccaccaacgccgatggatccatcgatctgagcaaagtaacccttaacatcggtgatcaaatcgccggaacagaacaagtgctccaagcttcaggggagctagatgatgtcccttataaaatcgaatggtcatcatttacctctggaccaccccaaatcgaagcattaaacgcaggtcaaattgatttcgcgatcaccggaaacaccccaccgatcatcggcggccccaccaacaccaaagtggtctccgcctacaacaacgatgctttaggtgatgtcatcttggtcgccccggattcttcaataacctcggtggctgaccttgctggaaagaaagtggctgtcgcccgcggatccagcgcccacggacacctcatccaacaactagaaaaagcaggcgtgagcgttgacgacgtagaaatcaacctcctccaaccctccgacgccaaagccgctttccaaaacggccaggtagatgcgtgggcagtgtgggatccctacagctcacaggcggaactggaaggagctcaagttttggtcaggggagcgggactggtcagtgggcatggatttggtgtcgcaagtgatgaagcgctcgatgaccccgcaaaggaagccgccttggcagatttcctcgatcgcgtggccgactcttatgaatgggctgaagacaacaccgatgaatgggcgacgattttcagccaagaatccggctttgatccggaggcctctcaactgaacacccgcagcctgcgccatcaggtgccgctcgacgagtccgtcaacacctatcagaacgcgcttatcgacgctttcgtctccgcgggtctcgttgaggactttaatttcgaggacaccgtagacacccgatttgagggctaagtatgtctgagtatggcaaaggggcgttgaggtgctcagacggccatacaaagcatcgtagtttgtgcatatgagggctgctttttgccgctgtgagttggctgttcaggaatccgtcctcgggttggggagaggggctgaaaccgaacgaatattcgcataaatctttcgaattggcgcgaatattcgatcccgctggcctccgaactagccattttggtagaaaatttgcatccttgagccggtattggcccaaggatgcattttcctgtgtcctacttctgcagtgagtagaactgagcactcatcgctgggacatgcagtgagagtgagtaggcgaaattatcgcgtggtgtcgctgctgcttgaacggaagtagcgatatcgttttctgcaccgaggaattcagcatcatcagtgttgagaacgagcttccattcgccacccgctgcaacaccgagctggtactcaggctgggaggttccagacaggttgaatacacacagcatctgggagccgtcgctgccgaaacgagtgaacgccaaaatgttgttggtggcgtcgtcgcccttattccatgtgaagccttctccggtgaaatcctgagtgtgcagcgcaggggagtctgagtagacaccgttgagggagcgggtcagagtgcggatggcttcgtggtactcgccttgccagccgtcgacaatatcccatggcagtccctggccttcagcccactcttcacgctgaccaaactcctgacccatgaaaagcagcttcttgcctgggtgtgaccacatgtacgcaaggaaggtgcgaagaccagcggccttgttccacgtatcgccaggcatacggtcccacagggaacccttgccgtggacgacttcatcgtgagagatcggaagtacaaaacgctcagagaatgcgtacaccaaggagaaagtgagctcactgtggtggaatgcgcggtgcacagggtttttggagaagtactctaaggtgtcgtgcatccagcccatgttccacttgagggagaatcccaagccgccgtcccacgttggtgcggtcacgccaggccatgaagttgattcctcagcgatggtgagcgcaccagggtgcagtcgcagcaccgtggcgttcatttcctgcaggaactgcactgcctcgaggttctcgcgaccaccgtagatgtttggttcccattcgccgtgctcacgggagtaatcgaggtacagcatggaggccacggcgtcgacgcgcagaccatcgatgtggaattcttcaatccagtacaacgcattagcgacgaggaagttgcggacttcgttgcgaccgaagtcaaagaccagggtgccccaatccttttgttcgccgcgcctccagtcagggtgttcatagagggcttcgccatcaaagcgggcaagagcccaatcatccttagggaagtgggcaggaacccagtccatgatcacgccaataccgcgggcgtggaaagcgtcgactagcgcacggaactgatctggagtaccccaacgagaggtcggtgcgtagtagccggtgacctggtaaccccaggaaccaccgaaggggtgctctgcgacagggaggaattccacgtgggtgtagccaagatctgcgacgtaatcaaccagctcagtagccaaatcctcatagttcttaccccagcgccaagaaccgaggtggacctcgtagacactcattggcttggatgcgagatcagtttgggaacgctcgcgcagccactcggaatcctgccactggtactcagaggaagcgacaatagatccggttgccggcgccagttctgcgcgacgagccatcggatcggccttatcacgacgttggccttccctggtttggacggcgaatttgtacacttcgccttcctctatgcctgggatgaacagctcccacagacccgaaccacccatagaacgcatcggatgctgggatgcattccaaccgttgaagccaccgaccactgcgcagccaattgcgtttggagcccacacagtaaatgcggtgccacgaactgttccgagcgcagtttggtaggtcttgatgttggcaccgagaatctcccacaaacgctcatggcgtccctcagagaagaggtaaatatccatctcgcctacggtggggaggaagtagtatggatcagccttgacctgcggttcttgatcaggccaggtgacttccaagcgatagtcagcgcgctcgcggtgacctaagtcaattgcgaaaatgtcgtcgccgataggggtcatgacgtgggaggtgtcgtcgataagcaaattaacctgcgtcgcgccgacctggcgcgtgcggataaccgaaccagcttcggtctcatgccaaccataaaatccatgaggatcgtgatggttgcagtggcgcaggcgggccagatctgcttcagggatggtgatgtggctcgcggggtcaacggtcatgatgataatccttgatagaaggtacagagatgggaaattacgcgcggtaggtcttgatttcgcgccacgcgagacgctcacggcgagacgctggaagttcaggaagaacaaagatgtgggcgacatcgcgtaggggctcgaggcggacaaagttcgtctctgaccacaggtaacgggagccggtgatcgcatcgcgcacctcaaactgtgcacccgcttctaagccaagcgctccaagatcaaggcgaacagtagcctcacgagcactacgtggatccaagttgaccacaatcaacacggtatttccggtcaaagcatcaaccttggagtaggcgatgatctgatcattgtccgcttcgtggaagtggatgttgcgtagttgctgcaaggcagggttcgcgcgacggatctggttgagcagagcgatgtaatcctcgagagaatcgccacgttccagagcaccctcgaaatcgcggggacgcagctcgtacttctcagaatccaagtactcttccgaaccaggcttgacggcctcgtgctcaaagagctcatatccggaatatacgccccacacaggagacatcgtggcggccaatgcggcgcggatagcgaacatggcgcgtccaccatgctgcagagacgcatgcaaaatgtcgggagtgttcacaaacaggttcggacgagaaatatccgccatgcgggcgatctcagtagcgaactcggtgagctcctccttggtgaccttccacgtgaagtaggtgtaagactgggagaaaccaatcttggccaagccatacagacgtgccgggcgagtaaacgcctccgctaggaaaatgacctcagggtttgatttatggatggcagaaataagccactgccagaaattagcgggcttagtgtgcgggttatccacgcggaatgtggtcacacccaaatccacccagaacttcaccacacgatagacctcttcgtagatcttcggagcatcattatcaaagttgatgggataaatatcctggtacttcttcggtgggttttctgcatacgcaatggtgccatcagccaacaccgtgaaaaactcgcggtgttcctgcgcccatggatgatcaggggcagcctgcagagctagatcgagtgcaacttccaaattgagttcccgtgcgcgagccaacaacgcctggaaatcttcaatggtgcccaaccgcggatgcgttgcatcatgcccaccatctttagaaccaatagcccacggcgaacccacatcatgaggttccggggtcagcgtattattgcggcccttgcggttgacctcgccaatcggatggatcggcgggaagtaaacagtatcgaagcccatcttcgcgacacgctccaacgcctgagcagtggtagcgaaagtgccatgaacgggggtgccggactcatcccaaccacctgtggaacgagggaaaagctcataccaagagttgaccaaagcggcacgacgctcgacacgaacctgcaggttttcacccatcgtgaccaactcacgcaacgggttaagttctaaaagatgagtgacactcgcggtgagcgctggggcgagacgtgcgcgtacatcgccgccgcgccgcagagaggaggcgacgtcgaaaagcgcagtcctatcctctttagacaaattctccgcagcacgctcaaacagctgagccccgtgctcaaagtcgttatacaactcatccgaaccctgaccggcctcaatcttagtggtaatcgcatgacgccacgtagccataggatccgaccacgcatctacacgaaatgtccaattaccagggacatcaggaacgaaaaatgcattcgactgatcctgattatcaggagtggggcgcatatgaatctgaataggctcagccgccactgaagaatcctccggaccggacacattcaacgtcgcggcaattgcatcatggccttcacgccacacaatagccgagacaggaacaatctcacccactactgctttcgctggatttccatccaaaatgcggggacgaacatcatcgataccgagacggccagtcacagttttctcctcaacatgcagtgtgaagtgcgaacaaacgcacacaagcttaaaagttcgatcaagcagacacatcggcaattagccgggggtatgtctccattatgaaagcttaacggagctgtgtcacttccacacggaaccggagaaatcagtcaagatgggagatgtgactaactctataaataactctgcagctgcatcttttccctctgatgaagaagaatccaatgaagacctcctcatcgatttccaaggagtcttctttaagagggatggtcgaaacctcgtcggccccgtcgactggcaagtagaactagatgaacgctgggtaattatcggaccaaacggagccggcaaaaccacactcatccgcatggcatccgccgaagaattcccctccggaggaatggcacgcctcatgggagaacgcatcggcaaaactgacatgcgcgacctccgctccatgatcggcgtcagctcctccgcattaggcaaccgaatcccctccgaagaaaaagtctctgacctagtcatctccgcaggctacgcaatcctcggccgctggcgcgaagactacgacgaaatggacttcggacaagccaccgaaatcctcgaacaagtcggagccatgcacctagccgaccgcacctggggaaccctctccgaaggcgaacgcaaacgagtcctggtcgcacgcgcactcatgaccaacccggaactcctcatccttgacgaaccaaccgcaggaatggacctcggcggacgcgaagacctcgtcggctacctcggagaactcgccatggacccagacgcacctgccatcgtcatgatcacccaccacgtcgaagaaatccccgccggattcacccacgcaatgctcctcgacgaaggtgaaatcgtagcccaaggcctgatcaacaccgtcatgacaaacgagaacctatccaaagcattccaccagccaatccaagtagaccgcatcggggaacgctactttgcccgccgtgtgagaaccgccaggagtcatagggctcagtaggttttttggagttgtgggccggtgttggaggggtggttgtttaataggcgacttcacgtatgcggacttcatgtgcgctgacttcttgcgctcaacttctcatgtgctgacttcactccggattgctggcatttagtagtgatgtcgtgtgatgagaagttgagtatgcgaagtcggtaccgagaagtcgacctttaggacatttttagaggagtccacgcagagactctgtctccgtaagttcgatttcacggttacgacttcgaactgtcgatatcccgggtgcggtttctcaattacaatttcgcacttccaatttctcaagagcgataccactaggaaaagtgccattttccgactgaaatcgccgttgagaaattgagcgcaaggtatcgagtttgcgaaatcggtaataagaaatcgtaaccgtgaaatcgaactttaaacccaaatgaccgaaaaagttcaaaccaacaagcatcaagtgacacattctcgtgcggactgcgcacggaatccatagactggtctgcagaagttttacgtgtgggtttgcttcggatggggctttaacaagcttcacagatgttggtttttcataggcaagctatccagaagtaggctttacagaaagtcagggtgtggcaatggtgatgcagggcattggtggtaggaagctggcggcgacggtgctgttggttcgggatgggatcatcaatgggcgtcctgatgtggaggtttacattcaggagcgtgtgtctactatggctaattttcctcgggcgacggtgtttccgggtgggggtgttgattctcgggattttgcggatggtcacggtaaggaagtgtggaggggacctagcgcggaggagtggggtgtgcgtttaggcgtggagcctcatgttgcgtatgcgttggtttttgctgcggttcgtgagttgtttgaagaggccggtacgttgcttgcggagcatacggatggttctggtttggtgaagaatgctggtcagtatcacggatatcgggagttgttggagactcatgagatgtcgctgacggatatgttgcagagtgagaatttggcgattcgtagtgatttgattgtgccttttgccaggtgggcgagccctgagggtaatagggagcagtttgatacgttttcttttgttgctgtggagccggaggggcagtgtgcggatggtaatacgtcggaggcgtcttcgacggggtattttcctgcacggctgattttggatggttggcgcgccgggttgttgaggttggttattccgacgtgggcgtcgttgtttgagttgtcgcagtttaagactgtggaggaattgctggagtacagcgcgcaggttgatatgtctcctgtgttggatgatgcggtggataatccgaggtatgcggagttttatcaggcgatgcgcacggaacggttttgatcatttaaggttcattcatgagctttagtgcggatgaggtgcgtttcctggcgcagtcggagcgggaaatcgcggagatgactgcggatcttgacttgagtaagaagtcgatgatttcggatgtggcgacgcttcggaagcacttcggtgacttcgggagggctgttgcagaactagcgggggcgaggcgcagcgcggtggggaagcttccgcaagattggctgatgtgtcaagaatctgcgcagcaaaccactccgcctgcggtgtcagcggagcgcgcccggcgtctgaaaactgcacttggtgagaacgtgattgttcatgatgtcacctgttccatcggtacggaggggcatgaacttatcgatgccggccttcgctacctgggttctgatctagatttctcacgcaccctcatggcagcccacaatctccagggcaaaaacgccctgattttccgcgccgacgcgctccagcccgcaagcaggggagccgacgtcatcatcgcggaccctgccagacgcgccgggggcaagcgcattacaaatccggcacagctcctgccacctctgccttcgcttctcgacgcctggatcaaccaaccactcgccgttaaatgtgcccccggccttgatttttcggaatggccaggtctcgtcagtattgccagcgttgatggaggcgtgaaagaagcatgcctctacactacggatctggcagatggggaaactcgcgaagctatcgtgatcaaagatgggctcattgaccgcatcaccaactttgaagacgatgccacgggacaagaccttgcggctgcacctggtgagttcatcatcgacccagacggtgccatcgtgcgcgccgggttggttcgccactatgcagtgcgtgagcagctgtggatgttggatgagcggatcgcataccttacgggcaatcggattccagagggtaccagcggttttaggtttattgaagaggttccgctgaagaagctgaaatcggcgatggcagcacatgatgcgggggcggttgaaattttagtgcgtggtgttgatgttgatcctgatcagttgcggaaaagattgcagctgaagggtaccaaggcgatgtctgtggtgatcactcgaattggcagccgaggggttgcattgatttgtggtcctcgcgagcgcgcctaaagccgatgcaaataaaattgccctggaaattgtgcacatcgcgctggattgcttagtctgttctatatagactggtttgtctgtcagcgcgtgtgtttataaagttgcgtgaaaaccgacggtaggtaggcgtcgaaaagcaatgggcgaagcccgcgtagtatgggcgggcaacgctaaaagcgccaaaaacgccaaaaatcgtgaattgaaaggtgagtgtggatgtccacaatcgtggttctggttaaaaatgttccagacacctggtctaagaggactctggaagctgatttcacccttgaccgtgagggtgtagatcgagtcttggatgagatcaatgagtttgctctggagcaggcactgcgcttgcgggagtccaacccggatgctggttaccgcgttgttgcgctgagcgccggccctgccggtggggaagaggcgctgcgtaaggcgctgtccatgggtgctgatgaagcaatccagctcagtgatgatgccttggctggttctgatcttttgggaaccgcttgggcgctgaacaacgctatcaacaccatcgcgggtgttgctctcatcgtgacgggttcggcttcttccgatggttccatgggtgcgcttcctggcgtgttagctgagtaccgccaggtcccagcgttgactaacttgtctgcgctgaaggtcgagggtgcatctattactgccactcgcattgataaccacggcacctatgagttgcaggctgcacttcctgcggttgtgtcgatttccgataaggctgacaagccacgtttccctaacttcaagggcatcatggctgctaagaaggctgagatcaagaagctttccttggctgaaatcggcgtggctccagagcaggttggtctgtctcacgcggcaactgctgttactgctgcagctgatcgtcctgagcgctcccaaggtgatgtcattggtgcatcgggtgctgctgaaaagattgctgagtacctcgcttcagagaacctcatctagccactatcttcacaaaggagaacatttaaatgtctatttcttatgtgctggttgagcagctagatggccgcccagaaccagttacccttgaattgatcactgctgctcgcgcactcggtgacgtcgttgccgttgtcgttggcgagccaggtgccggcgtaaaccttgctgctgagctcggcaattggggtgcagcacaggttgtttccgctgaaatctctggcgcttccaaccgtttgatcttgcctgctgttgatgcgctgcacattttggctgcgaacaacccaggtccaattgttatcgctgcaactgcaagcggtaatgagatcgctggtcgtttggctgcccgtttggcttctggtgtgctcaccgatgtcgtcggaatcaatgccgaccgcaccgcacagcagtccattttcggcgacaccattcaggtgtccgctgcagttggtggcgcttcaccgctgtacaccctgcgtccaggtgcccttgatggcgtggccgttcctgcaaccggtgaattggcaaccattgagatcccaggcgcaaccgccaaggatgtcaccatcacctccttcacgccaagcacccagagcgatcgccctgagctgccacaggcaaaggtcgttatcgcaggtggacgtggtgtcggaagcgaagaaaacttccgcagcatcgttgaaccactggcagatgcattgggcggtgccgttggcgcaacccgcgacgccgttgatctgggctactacccaggcgagtaccaggttggtcagaccggtgtcaccgtgtccccagacctctacatcggcctcggcatttccggtgcaattcagcacacttctggtatgcagaccgcaaagaaggttattgtgatcaacaacgatgaggacgcgccgatcttccagattgcggacctcggtgtcgttggcgacctctttgacatcgcccctgcgctcatcgaagagatcaacaagcgcaagtaggagttttgaacactttttatctggaccatgcagccaccacaccaatgcgtgaggtggccgcagctgcgtggatggaaaacgcgcaggcattgaatcccgcgagtcagtacggttcggggcgtaaggcgcgcagcgttgcggattcggctcgtgaagaaattgcttctttgctgggctgtgaacctatcgaggttgtgtttaccgcgtccggcacggaggcagataacctcgctgtgcaggggttattccacgcatcgcctctcaatcggattatttctacgccgatcgagcaccccgggattctggaaaccgtcaaggctctagaacttggcggggcagaggcggagctcatgccgatcggtccagatggacgagtgtcttccttcgaagcgctggacaagcctgccgcggttgccactatgatgtgggcgaacaatgagaccggcgcgattcagccggtttctgagttcatcgccgccgcgcaggcgtccggcacgccaacacacatcgatgcggttcaggtcgttggccatctgccggtcaattttgatgagctcggcgccaccactttggctgcctccgcgcacaaattcggtggaccacgtggcgtcggcctgctgttggtgaggcgctcaccagcaccttcagccgtattgcacggaggtggtcaggagcgcggcatccgtccaggcacccttgatgtcgccggcgcagctgccaccgcagccgcattacgcgaagcagtggccgagcttgacggcgaagccacccgcctgcgcggacttaaaaagatgcttctcgacgccatcctccacaccatccccaacgtactggtccacaccaccgaaccatccctgccaggacacctgcatctctccttcccaggagcagaaggcgatagtttgatcatgctgctcgactccttgcggatcgaagcctccacaggttcggcctgctccaacggtgtaaaccgtgccagccacgtccttttggccatgggaatttccgaaaccgacgcccgtggtgccatccgattcaccctcggaagaaccaccactgaagaatccatcaaggcagtgatcgccgtgatcgaagacgtagtgaccagggctcgtactgcgggaatggctttttagcgaccgtaaatcgcatagtgcagttccgttgccagcgggcagatcacctgctggtgcgacagcggaacattttggcagtcgccaacaacgggagatcctgttgacagcacgatcgcaccaaaaagtccgtgaaacatcacggtttcttgggaacgattcaacccagtcgatgtcatggttggtccatagggatccaccatgtcgtgttctggaaagtgcgaggaaatcgtgttggcctgggcacttggagcgaacagcacagcgctagcgatagtcacagcagcgattgttgataagtatttcttgatcattgttcaaacattaatggtttatgctgattgattctccgcaaggcgagacaaaagtaactctagtttcggcttgcgttccaataccgtcctatttgaccagaaatcagttccgcgaagatttctggtcatatggtctggttttgaccccaactaaccgtcccaggtgaccaatgcgcgctgaggtggagagttttcggtcacctggtttggtccgtggcgggacaatagaaaaactaccccagtgcctacaaaaagtggcctctcagaatcgtctctgagcgcttaaaactaccactgtcatgcctttactcatttaagtttttcgacctcttaaacaggcgaattaagctccccatgcgcttcgtcgatgtttgagaaccctggccagatctcgattcatccgtgtatcaaaatttcccgaagcaagaattgtctctgcggcattttctgttgccaacagtgcagcgttcgcaaccgacatggctgttttttctggtagtccgatggatgtacagaattttaggaatttcttttggctgagatcctttttggatccctggatttctaatgccatcgtggtgtcgccatatactgcggtggcagggatgtcatagatggggctgatctcaaatccgcggcctttgttgataatggagatgttcttggcatgaagatcaccattgccgctgagccacgcgactgcgatttggaaggcgagattgcgcatcgccaagatgggggaggcgcacactttagtgagggcttgtgcgatgtcctcgtagctcactaagtatttatctgcaggccagattcccaagacctgtcctgcatcctcgacggggattttgcctttgggtgtgcggtcaaagcggtgaactaagagtccggacctgccgtgtttgtcatggagaacttctactttggacagttcaatgcgaagcttatttttggtcagcaactggtaacaagctgcttcgttttccaccaagtaagggtattcaggcggggagagtttcaagatggcatcgcttgcaacggggaccgcgatggtgcgtgcagaggctttgtcttggacaccggccagtgcaacgggatccgcaatcccggactcggttagtgcagccgagaaatcaagttcatcgtcaaaatcaactgtgggtggtgcaggttgtggattttcaccatgggggaagatagcgactgcaccaacaggatcagctcccactgctagaaggagtgaaagttcatcatcggcagaggctttaatgtttctccgaagtgaacttaagcgacgaccttcggggagtaatcccgcgaaaaatggtgggatcgctccagagcgcgtaatcacgggttcagaattgatgggcagggacgtggcaatcggtggacctgcgtaatcagctgtgtaggagaatgtggtctggtcgccgtcgcgtgtgaaatgagcagccaaagtatctttaaaccagatatcggcagtgggggtcattgattaaccttgaggggatcgtgaattccaacagaaagctcgagtccaaggacgcggagtacatcgatgactttgtccaggcggacggtagtttttcccttttcgacatcgcggatgaatcgttcagaaactccagctaagtctgcgagctctccttgtctaaggcctagctctttgcgtccgttgagcagcgccattccgatttcttctgcgttcatgtgcatcctttggatccaactttcggcatgatcgtgccgttctttgcagtatacatccgtttcggagcctaaacaaggaaaaccggcaagatcgtgccgagtttccggtttggatggggtttgggatgttaatgggagaggatcggcgtgatcgtgccggtttttcttgcgttggtagtcttggggctatgagcgcattccacatccgagcggaacaatcgcgcgatatcagcgcgattcatgatgttactgaagcggcctttacaggaattgagcattcagatggaacagagcaagatctcgtcgataagcttcgtgctgcaaaggcgctgagcctttcgctcgtcgctgaggcggatggcgaggtcattgggcatatcgcagcctctgaggtactgatcggcggtggggtgcagggctggtttggcattgggcctgtcagtgttcggcccgataagcagcagcaaggcgtgggtattgcgctgatgggcagcgcgcttgatcagttgcgtgcggagggtgctggcggcatcgtgttgctgggggatccgggctattatcgacgcttcggttttgaggtcgtgcccgggctggtctatccggacgcgccagcggaattttttatggctgtgtgtttgaatgctccggcgtttccgcagggtgttgtggagtatcactcggcatttggagggtagagaccccatcgtggcgggcctgggctcccgaggcgaatttccgcacccaggattcatccttgtactgcgctggaacgccgccgccaagaagctcacgggtaatcgcggacgcttccgtgctgttggagctaaagaactcggtgtctgaacccatcaaaatgatgttgccgtaacggcgccctttaagcatcgggggatcggcgatgaccgcgacgtgctcgaacacctccatcattcccgcgagctcagatttagctccgcgcagatccgaatgatcgccacagttggcaacgtacaatccgccgggagcaaggccacggtgacagtgctcaaagaactccacggtggtgaagttctgcggcgtgatagctccggcaaaaacgtcacggatgatcacatcgcggcttgcgggagtgaaagattctgccaccattcgggcatcatccacacgaatctttacccgtggcgcgcgcggaatgtcgaaccattcacgcgacaggcgggcaagctctgcatccaattccacgacagtgttgcgtgactgcgggtaaacatccgcgaaatacctggccatcgtgcacgcaccgccgccgaggtgagtaatccgcagcttggatgcatcctgatgcgcatcgatgaacgcccgagcgccggtagcgatccaccgcatgtactcaaattccagtgcctgcggttgccccaggacaatatgagagctgggcacgccattaatgctgatcaaccagccatcggtggtgtaggaatcggcctccaactcgatgacggaatattcaccctcataggtgccagcaatgggcgtgttggcagcttgggagcgggattgatcggacgtgtttttcttacgggccacgaaaaagctttctttctttaatgctgttttagtgcttgtgtcttatgtgattggtcggtggtgcgggctgttgaggaggtgctcgcgcatgtacggcaaagtgaaattgaggaaaccgtacttgggaacctctacgagacctctgctgagaagttgctttctctgcatcgacaaggcgttgggcttgacgcccatgaggtgtgcgatatctccagtagacaccatctcgccgttttttgacagttgggcaatcgcgtacaaaatggtcagctcaccatcagggacctggtgcaggcttggctcgtggacttgcatgcccatgcggcgcacaacctcgtcgcggacagcatctacttgttcggcctggatggtatcggagttgtcaagagtacttcgcgcccatgccagagaaccagtcagctgcatggagtaggggtagcccttgctgatctgcgccgcgagttcggcggcctcggaagtcatgtggcgttggccttccgcagcggtatccaggaacatctccaccgaatcttcatggttgacaggattgagcaggattctttcggctcggcggataaaggttgtgccctcatgctggagaagacgatcgattccctctggcagacccgctgctaccaatgcgatatcgaaatcatcccgtaggagatcctggaccgcagtggccaacacatgcaaaagatccacattggcgctttggagttcatcaagggtgatcaaaattccggagccgtgcttttgcaaacgagtagccaactcgcggagcctggaaatcagcgtgggagtgggatccttcttggttggatcagcaatggccgtcaccgtagcgataccaggaatggccacaccactgagcattcttttggactgcggtccgtcaagattctgtagcgcctccgggatggcggaattaactaagccatccaccatggaattatccggataggcgcgcagcgtgatccacccttgagacgcagctgcatcttcaaattcattgagcaacacagttttacccatgccacgagatcccgaaatcagcaatgctctaaaggggcttccggggccttccgcgagaccaagtttgaaagactgtagaagtgagtctcggcctgcaagtacggtgggggaaactccgaaagtggggcggaacggattgcgagctgacatagaagacaccttggatggtctagtcgggtttgcggaatgcagtgctggcttgtgttggaactgaactttagatcttttagaagtctagcgtgagtttagatcttttagaacccctgtgaggggttagatcctttagaactttccctgttgtgggataagcaacgcaatagtagaggcggaagcaatgagatttgaaacagaatatgtcgagcggctttatgtattttctacaacccaacaggctcaagagatttccgaagaactagcagttgaatttttgaaagaaaaccccgatatctcacaccatgaaatattggtccaacactcagcggaagacacatttgaagttgaaaaggtctgggtggaaatgttcggagacagcacagacatccaagaccgcacaatttcgctcattgaatataggttcactatcaattcaaatgcggatgaagacatggatgaactcagcatgggtatttacgcggtcatccgggctctaataaaaaagcactcaaaggtggagtatttcagcatgttttcgcttgcatcagatttacttgcgtcagatttagaggaagagtgaatgctcaaccgcgaaagcttgaaaatcctccccaaataaaagaaattcgggatttcgggaacatgcggatacgctacgttgttgagattaattaagtaaacgtaggcagaaagctttgtagaggggagatcatgcgggttcttgcagcaatgagtggaggcgttgattccgccgtcgcggcgtcacgcgcggtcgcagctggtcatgaagtggttggcgtgcatttggcgttgtcgcaagatccgcaaacggtgcgtgagtcttcgcgcggttgctgctctctggaagattccgctgatgctcgtcgcgtgtgtgacaagttgggtatcccgttttatgtctgggatttctcggatcgtttcaaggaagatgtgatcgacaacttcattgattcttacgcgatcggtgagactccaaacccttgcctgcgttgtaatgagaaaatcaagtttgccgccttgcttgagcgtggcatcgcgcttggtttcgatgcagtggttaccggccactacgcgcgcttgacccagcctgctgatggtggcgatggctacttgcgtcgcggagttgatcccaacaaggatcagtcttacgtgcttggtgtgcttggcgctcatgagatcgagcactgcatgttcccagtcggcgataccatcaagcctgaaatccgtgaagaagccagtgctgcaggtttctctgtggcaaagaagccagactcctacgacatttgcttcattccggatggcaacacccaggcgttcttgggcaagcacatcggtatgcgtccgggcatgatcgtggatcaggaaggcacgcagctccgtgagcacgctggtgtccatgaattcaccattggtcagcgcaagggccttgacattaaggctccagcagccgatggtcgtccacgttacgtcaccgatattgatgccaagaccggcaccgtcaccgttggtactcgcgaaaacctaaagatcagcaccatccacgccgatcgtttgaagttcctccatccagcgatggacggacagatcgattgcgaagtccaggtccgcgcacacggtggagtagtttcctgctctgcgacgattgatcgtgacgctgatttcatggtgctcaacctcaatgaacctcttcagggtgttgctcgcggccaggcagcagtgctgtacctgcctgacgcggatggtgacatcgttcttggatcaggcaccatctgccacacggagtcttaagaaaattgggcgcttatggtttaggtgagcttcctggaaaatccgccgcggaagccgccgacattattcagggtgaaacgggcgatcttctccatattcctcagcttccggcgcgaggtttgggtgctgatctgatcggtcgaaccgtcggtctgctggacatgatcaacgttgatcgcggggcccgatcttgggtgatgagcacacgccccagcagattgacgcacctgaccggcgatttccttgacatggatttggatgcgtgcgaggaaacctggggaacgggcgtcgacaagctaaaaatccaagttgctggtccctggactttaggtgcgcgcattgagttggccaatggccatcgcgttttgtctgatcgcggtgcgatgcgtgatctcacgcaggcgctgatcgccggcatcgatgcgcatgcacgcaaggttgctgggcgatttcgcgccgaagtgcaggtgcaaattgatgagccggagctgaaatcgcttatcgacggctccctccctggcacttccacctttgacattattcctgcggtgaatgtcgctgatgccagtgaacgtttgcagcaggtctttagctcgattgaggggccgacatatctcaacctcaccggccagattcctacttgggatgtggctcggggtgcgggcgccgatactgtgcagatttccatggatcaagtccgtggaaatgaacatttggatggttttggtgaaaccatcaccagtggaattcgtcttggtttgggcattacgacaggaaaagatgtcgtagatgaactgctcgagcgaccgcggcaaaaggccgttgaggtagcacgcttttttgatcgtttaggtgtgggccgaaactatctcgtggatgctgttgatattcatccgggtgaggatttggtgcaggggaccatcaccgaggccgcgcaggcttatcgcatggcccgggtgatgtcggagatgttgtcgaaggattcaggcgacctttaaggctttaccggcgctgggtgtgcattttttcctgccatcgttgatgccacaatgccgataaccagcaccgcagcggcaagtagaagtgcttgaccaaaagctgcgccctcatcgcctgctgccagtcgaatctgcattaccgcgccgatggcagcggcgccgatgactgaacctaattggcgggttgtattgaacacgccagagcccgctcccatgaacttgtgtggcaggtcgcgcatagtggaggtcgagttcggtgcccacacaaaggcgtttccgatgccgagcaaagtcatcgaaacaagtgcccagactagacccgtatcgaaaatcattaccattgacagcagtacaatggacacagccactgtgctaaaaccgagggctgccatgagtccagggttggatcgatcaaccagctttccaacaaatggtgacagtactgctgccatgagagcttgaggcaccatcatgaaacccgcttccatggcgttcattccgtgtgcttgctggaagtacaacatgatgggcagaggagtaccagccacggtgaatcccatggccatgatgcagatattgccgaggctgaagtttctaaacttgaaaatctccagtgggacgagaggatcgtttccggatttctcggccctgctttgttggtagataaaccacgcaaagagcgcaaaggcggctacgatcatgatccacacccatgccgcccagccagcgccttcgccttcctggaaagcaaacaccaggaagaacacggccacgatggacaacacgatagaaagcggatcaagcggtcgggtcagcggtgggaattcaggaacgtacttcattactgcgatcaccgagatcacgccgatgggcacgttgatgtagaagacccattgccaaccccagttttcggtgatgacaccacccaggatcggtcctgctagggatgcaaggccagctgtagaaccccacactccaagagctgcaccgcggcgctcaaaagcaaagatgcggttgattgttgccatggtttgtggagtcaaaagggctgcgcccaaaccttgaacgccacgagcgataatcaacgtgaacatgtctggggccaaaccacaggccaaagagctcactgtgaagataaccatgcctgcgacatagacatttttcggaccgtacttgtcgcccaaacggccagtaacaagcagtggcaccgcgaaagtgaggagatacaccgaggttacccagatgacctcgttgtaggacgcgcccatgtctgcctgtaacgctggggtagagacggccacgatggtttgatccaacaggatcatgaaaaacccaatgcacaaggcaattagagctggccaagcttgcttttcaggcaagggcatggcggggtaggccttggtttggggtgcagcactacctgctgcggaggatgttagatcctgctttttgtcagacacgttgagttattctttcacgcacgagggcgcctggaaaaggccttcaattctttgaggtagaaatctggcgcggtttaggatgcggggtcagtttgcactggccatgaagtgttcacatcgctggcatcgcggccttgcccgatgagatagctacggaagctcttttgttgctcgtaatagttgactgcttggaactccatgagttcttcgcctgtcatcttggtgagttctggccacaggcggacctgcttccaggcgatgcgtgcggctgcgagcgcatctgaggtggcttcgtgggcgttgcctaattgaacgtcgtagtgagcacacatatcagtgagtgtgcgcttgcctttgcggtaacggtctttgactttgtcgataacgaaggggtcataaactaggccgtcgatggtgaagcttggatcatggtttcttaatacggtcaggtcataggatgcgttgaagacaatgaccgacagtcctgcctgccagccggcgcgcagcctggagatggtttcggctaacacctcatcgtgcggacggccgttggcgcgggcatgttcggtggtgatgccgtggactgcagtggcggcctcggggatttcgatgccggggtcagccaatagctcaataggctcagcgcctttgctggtgatcgtaaccattgcggaggtgacgatgcgggtgtcaaagggattgacgcccgttgtttccaggtcgaaggagagcatcttggtggtgtcgaagcttgggacggtgggagatggattgcttggtgagttcatggttcctaaccctaatagtcgcatgggacaccgggtgcccccggtacggttttaagcaggtctgcacccattcatacgcgaattttgacgtgagttttagctttccgagcacctgtgcgaatggccgtgtccacccttagggttagaatcgggaaccgtgactgaagataatgctcaactgcgtagaacgtggaacgacttagccgagaaggttcgttatcaccgagatcgttattacaacgaacagccagagatccctgatgctgattttgatgcgctttttaagcagcttcagcagttggaagaagaccacccggagctcgccgtccctgatagccccaccatggttgtgggcgctccggtggcagagcaatcaagctttgacaatgttgagcacttggagcgaatgctcagcttggacaatgtttttgatgagcaggagttgcgtgattggttgggcaggacgccagccaagcagtatttgacggagttgaaaattgatggcttgtccatcgacttggtgtatcgcaatggccagttagagcgtgccgctactcgtggtgatggtcgcgtgggcgaggacatcacggccaatgctcgcgtgatcgaagatatcccgcaccagcttcagggcactgatgaatatcctgtgcctgctgtgctggaaattcgcggtgaggtgttcatcactgtggaggatttcccagaggtcaacgcgcagcgcattgctgatggtggcaagccgtttgccaacccgcgtaatgctgcggctggttctctgcgtcagaaaaatattgaggacgtgaagaagcgccgcctgcggatgatcagccatggcatcggtttcactgaaggctttagccctgcgtctcagcatgatgcgtatctggcattggctgcctggggtttgcccacctcgccgtacacagaggctgtgactgatccagaagatgtggtgaaaaaggtcagctactgggctgatcaccgccacgacgcactccatgagatggatggcctggtgattaaggtcgatgacatcgcatctcagcgtgctttgggttccaccagccgcgcgcctcgctgggccattgcgtacaagtaccctccggaggaggtcaccaccaagctgcttgatattcaggttggcgttggtcgcaccggccgtgtcaccccattcgcggtcatggagccggttcttgttgcaggatcaacggtgtctatggcgacgctgcataaccagagcgaagtcaagcgtaaaggcgtgctcatcggtgacaccgtggttatccgcaaggcgggcgaggttatcccagaggtgcttggccctgtcgtagagcttcgtgacggcacagagcgcgagtacatcttcccaacgctgtgccctgaatgcggtacccgtctggcgcccgcgaaggccgatgacgtggattggcgttgccccaacatgcaaagctgtccaggtcagctgtccacgcgtttgacctaccttgctggtcgtggcgcttttgatattgaagcattgggcgaaaagggcgctgaagacctcattcgcaccggcattttgcttgacgagtctggcctgttcgacctcacagaggacgatctgctgagctccaatgtctacaccaccaacgccggcaaagtaaatgccagcggcaagaaactgctggacaacctgcaaaaatccaagcagaccgacctctggcgagtcctcgtggcattatctatcaggcacgtaggccccaccgcagcgcgcgcccttgcaggtcgctaccactccatccaggcgcttatcgacgcccccctcgaggaactctccgaaaccgatggagtaggtaccatcattgcccaatccttcaaggactggttcgaggttgattggcacaaggccatcgtggacaagtgggcagccgctggtgtgactatggaggaagaagtaggggaggtcgctgaacaaacccttgaaggcctaaccatcgtggtcaccggagggttggaaggcttcaccagagattcggtgaaggaagccatcatctcccgtggcggaaaagcctctggatctgtctcgaagaaaactgactacgtggtgattggtgaaaacgcaggttccaaggccaccaaggcagaagaactagggctgcgcattctggatgaggcaggattcgtccgtttgctcaataccggctcagctgacgaatagtcgcacatgaaaatgccccaaggaacatcttccttggggcattttttaaacagctcagattatttttgaagcattgctccgataatgtcaccgacttggcctaagtgctccacttcgctggccaagaaatcagggccaccagggcgaccgataatcagagccaggccgtgcttgccgatcggagcgatggcaagggaagaatcaagcagtgtccaggactctggaatccacggatcgttttccgggttgagcatgcgagcttctttgagaacgatgttctccggaacggtgccgtcatcttcgggcgctgctagggaaccagcgatgcgagtgatgggtccttttagatcaatgaccaaagcccaaccagaggtcatggtgcgggggatgacatcgaccatttcttccatcgctgcggtgatatcgcggcgttggtgagcaacagcagccagcatttggatctgtccgcggcggtcaacagtcccggagaatgggcggatggaatcaatctccacgccgtcgacttcttcagctgcggtgatgatggtgtctgccatgacatcgcgagggatggagatcaccagatcgtccatgaccgtgccattggggaagcgttccaccacgtccacggattgaatattggcctctacaatcccaagggcttcagcgagtaacgcgaggctgcctggggtgtcggacaacaggacgcggatcaggaatgacattggctcgcttccttcttttcaaaactaggggatgattggtttcgacagtaccaccgtatttttacctcaggctgaaaaacaccttattgattttggctcatggttataccctcgccgatgcgtgtccacctcgtgcagtaagataaaccaacagttgcgcatgcgtgcgcaagttaaattttcttgtacccattgtgactagcgaagaggatcagaaaccaagtgcctgagatttcgcgcgaccaggtcgctcaccttgccaaactttccagactggcgctcactgaggaagaactcgagcagtttgctggacagatcgatgacattgtcggatatgtttccgcagttcaaaacgtcgacgccgcaggtgttgagcctatgagccacccgcacagcatcgccaccaccatgcgtgaagatgtcgtgcacaagaccctcgatgctgcggctgcgttggaccaagcgcccgctgtcgaggatggacgttttatggttccgcagattctgggtgagggcgactaataattatgaccaacaagtacctggttgaaggctctgaaaacgagctgaccacaaagaccgcagcagagctggcaggtcttattcattcccgcgaggtaacttcccgcgaggttactcaagcgcacctagatcgcattgctgcggttgacggcgatattcatgcatttctccacgttggccaggaggaggccctgaacgcggcggatgacgtcgataagcgtctagacgctggagaggcacctgcctcggctttggctggcgtgccgcttgcgctgaaggatgtctttaccaccactgatgcgccgaccacggcggcatcgaagatgcttgagggctacatgagcccttatgacgcgactgtgacccgcaagatccgtgaggctggcatcccaattttgggtaagaccaacatggatgagtttgcgatgggttcctccactgagaactccgcatacggcccaacccacaatccgtgggatctggagcgcaccgcaggtggttctggtggtggctcttcagctgctcttgctgcaggtcaggcgccacttgcgattggtactgacactggtggatccatccgtcagccagctgcgctgaccaacactgtcggtgtgaagccaacctacggaaccgtatcccgttacggtctgattgcgtgtgcgtcctccctggatcagggtggcccaaccgctcgtactgttctggataccgcgcttttgcacgaggttatcgcaggccacgacgcttttgatgcgacctccgtgaatcgtccggttgctcctgttgtgcaggctgcccgtgaaggcgcgaacggtgacctgaaaggcgtgaaggtcggtgtggtcaagcagttcgaccgcgacggctaccagcctggcgtgcttgaggcattccacgcttctgttgagcagatgcgctcccagggtgcggaaatcgtcgaggttgattgccctcactttgatgacgctcttggcgcgtactacctgattcttccttgtgaagtttcctccaacctcgcgcgttttgacggcatgcgttacggtttgcgcgctggtgatgacggaactcgttccgccgatgaggtcatggcgtacacccgtgcgcagggattcggccctgaggttaagcgccgtatcatcctcggcacttacgcgttgtctgttggttactacgacgcgtactacctgcaggctcagcgcgttcgtaccctcattgcacaggacttcgccaaggcttacgagcaggtcgacatcttggtgtccccaaccactccaaccaccgcgttcaagctgggggagaaggtcaccgatccgctggagatgtacaacttcgacttgtgcaccctgccactgaacctggctggtctcgcgggcatgtccctgccttccggcttggcatcagatactggtctgcctgttggtttgcagctgatggctcctgctttccaggacgatcgtctctaccgcgtcggcgctgcttttgaagctggacgcaagtaggttctaaaccctttttaagaaattggctgccctcgcatgactgtgcgcgggcggccaattttttcttttgtgggggtgcctcttacgcatttcctgaatttttgttaggcttgcctaggtcagttaaagatatatcgataagaggttttccatgaacactccagcgccccgcaaacgacgcgaaatgaaaatcaagacagcaaccgtcactggtgtgcgtcaaatttcccccgatctcatccgcttcagcttcgactgcccagaaatcgttggcgccgacctggggttcacggaccattacatcaagatcctcttcgtgccagcaggtgcggattactcctggcctttcgacatggcagaaattgcggaaacccagccccgtgagctgcaaccagtgcgccgcacctacactttccgcacggttgacactgtcgcaggcacatttgacatagatttcgttgcgcacggcaccgatggccttgccggtccttgggcgcagcaggcacaggtaggtgatgtcatcgcgttcggcggcccaggtggcgcatggaagccagaaaccacctatgagcactacgttctcgcaggcgatgaagccgcagcacccgcaattttcgcagccttagaacacctacccgccggcaccaccgccaaagccttcattgaaatctcctccaacgaagcgcgtttcaacgccccagccagcgacaacatcgaggttgtctgggtgccccgcgacggcgccacccacggtacattgcttatcgacgccctccgccaggacggctacccaaccaagaaaacttcctggttcatccacggagtcgccgaaatggtgaaggaaacccgcaaattcctcttcgtggaaggcaacgtagacaaagctgatgcatccatttccggatactggcgccttggcatgaccgaagaccagtggcaggcctccaagcgggagttcaatgagcaaaatgaggcagaagaactcgcgctcagcaaggcataagggcaaggggttctagaaagaccaacggacgtgttttcccagctcccattggtttaaaaagctcatttcgaggcctgaaaaacgtgcgaatcaggccaaaactcgagtagcccggaatgattttggtttccttctgcgagttcgccatgtgactgcggtaaaactgccccggaaccggaatatctcgacgccacagaacgccatttgcgggccttaacaccccgtgggcataccttttacccattccagatattcggtcgcttaaattgcctagtgtgattccaaacagaaatctggggcgacctctaataagagtcgccccgataagtttttttaccgtaattattactgggagtcagatactgcgtaagcaatcgcagcagcgccagcggtcacagtaagaactgcaggccacgcgccaatcttcttggcaagtgggtgggacaggccaaatgcaccaacgtaggttgccagcaggccagtagctactgcaggacccttcttttcattccagcttcgtgcagcaagcgctccggatgctgccaatggaatggtgcccagtgggcgaatgccggattcacgggcagtcaaccaaccgccgatcaaacctgctgcgacgacggtggcagtgctgacctgggatgcctttttcaatttcatttccatggtgagccagtctagagacaaaatttttccgcgggggttttcttgatctgatccgacaacccaatgggggcaaaaatgtgtccgaccaaaaattgtgcagcacaccacatgcccgctcggacaatgtcgatttgttaatgaaactgcagctctggcgattaaataagatggtcagagacagttttttggcctgtcaacccctgtgattctcttatttttgggtgattgttccggcgcgggtgttgtgatgggtttaatatggaagacatgcgaattgctactctcacgtcaggcggcgactgccccggactaaacgccgtcatccgaggaatcgtccgcacagccagcaatgaatttggctccaccgtcgttggttatcaagacggttgggaaggactgttaggcgatcgtcgcgtacagctgtatgacgatgaagatattgaccgaatcctccttcgaggcggcaccattttgggcactggtcgcctccatccggacaagtttaaggccggaattgatcagattaaggccaacttagaagacgccggcatcgatgcccttatcccaatcggtggcgaaggaaccctgaagggtgccaagtggctgtctgataacggtatccctgttgtcggtgtcccaaagaccattgacaatgacgtgaatggcactgacttcaccttcggtttcgatactgctgtggcagtggctaccgacgctgttgaccgcctgcacaccaccgctgaatctcacaaccgtgtgatgatcgtggaggtcatgggccgccacgtgggttggattgctctgcacgcaggtatggccggcggtgctcactacaccgttattccagaagtacctttcgatattgcagagatctgcaaggcgatggaacgtcgcttccagatgggcgagaagtacggcattatcgtcgttgcggaaggtgcgttgccacgcgaaggcaccatggagcttcgtgaaggccacattgaccagttcggtcacaagaccttcacgggaattggacagcagatcgctgatgagatccacgtgcgcctcggccacgatgttcgtacgaccgttcttggccacattcaacgtggtggaaccccaactgctttcgaccgtgttctggccactcgttatggtgttcgtgcagctcgtgcgtgccatgagggaagctttgacaaggttgttgctttgaagggtgagagcattgagatgatcacctttgaagaagcagtcggaaccttgaaggaagttccattcgaacgctgggttactgcccaggcaatgtttggatagtttttcgggcttttatcaacagccaataacagctctttcgcccattgaggtggaggggctgttttttcatgccgtaaggaaagtgcaagtaagtgaaatcaagtggcctagatccattgacacttagactgtgacctaggcttgactttcgtgggggagtggggataagttcatcttaaacacaatgcaatcgattgcatttacgttccttatcccacaataggggtaccttccagaaagttggtgaggagatggcttccgaaacctccagcccgaagaagcgggccaccacgctcaaagacatcgcgcaagcaacacagctttcagtcagcacggtgtcccgggcattggccaacaacgcgagcattccggaatccacacgcatccgagtggttgaagccgctcaaaagctgaactaccgtcccaatgcccaagctcgtgcattgcggaagtcgaggacagacaccatcggtgtcatcattccaaacattgagaacccatatttctcctcactagcagcatcgattcaaaaagctgctcgtgaagctggggtgtccaccattttgtccaactctgaagaaaacccagagctgcttggtcagactttggcgatcatggatgaccaacgcctcgatggaatcatcgtggtgccacacattcagtcagaggaacaagtcactgacttggttaacaggggagtgccagtagtgctggcagaccgtagttttgttaactcgtctattccttcggttacctcagatccagttccgggcatgactgaagctgtggacttactcctggcagctgacgtgcaattgggctaccttgccggcccgcaggatacttccactggtcagctgcgtcttaacacttttgaaagactatgcgtggaccgcggcatcgtcggagcatctgtctattacggtggctaccgccaagaatctggatatgacggcatcaaggtgctgatcaagcagggagccaatgcgattatcgctggtgactccatgatgaccatcggtgcgttgttggctcttcatgagatgaatttgaagatcggtgaggatgtgcagctcattgggtttgataacaacccaattttccggctgcagaatccaccgctgagcatcattgaccagcacgtacaagagatcggtaagcgtgcgtttgagattctgcagaagctgatcaatggggacaccgcgcaaaaatctgtggtgattccaacgcagctcagcatcaatggatcaacggcggtttcccaaaaggcggccgcaaaggcagcaaaagcagcccaaaaagcagccgcgaaagccgcacagaacacgcaacacgaggtgagcctagatggtgaactctgaacaagcgcttcatcagcatgatcctgcaccaatccttcagttggataaagtctccaagtcgtttggcccagtcaacgtcattaatcaagtgagcatcgatgttcgccctggcagggtgcttgcgctgttgggtgaaaatggtgcgggtaaatctacgctgatcaagatgatgtcgggtgtgtatcagcctgatggcgggcagattttggtggatggaaagcccacgactttgcctgatacgaaaactgctgagtcttttggcatcgctacgattcaccaggaattgaatctggtgcccacgatgacggtggcggaaaacgtcatgctgggccgcactcctcggaagtggggtttggtcaatttcaaacatttgcgcaggcaggcacaggcggcgctggatctcatcggcgtggatgtggatctgaatgctcaggtgggttctttaggaatcgctaggcagcagatggtggagatcgccaaggcgttgtccatgaatgcgcggatattgattttggatgagcccactgcagcgttgactggtcgtgaaattgatcagttattcaaagtggtggatcagctgaaagaaaaaggcgtggccatggtgtttatttcgcaccacttggatgagatcgcgcgcatcggcgataccgtctctgtgctgcgtgatggccagttcatcgcggagctgccagcggatactgatgaagatgagctggtgcggctgatggtgggtcgtagcattgaaaaccagtatccgcgtagtgcgccagagatcgggcagccactgttggaggtgaaaaacctcaacgcggagggccggttcacggatatttccttgactgttcgcgctggtgaagtcgtaggccttgccggtcttgtgggtgctggtcgcacggaagtggttcgctcgattgctggcgtggacaaagttgattccggtgaggtgatcgttgctggcaagaaattgcgcggcggcgatatttccgaggctattaaaaacggcatcgggcacattccggaagatcgaaaagcccagggcctggtgctggggtcgtctgtggaggacaacctgggattggcgactttggcgtcgacagcccgcgcaggtttggtcgatcgatcaggacagcacaaacgagccgccgaggtcgcggaaaaactccgcatccggatggcaagcctcaaacaaccgattagcgatttatcgggcggcaatcagcaaaaggccgtgttcggccgctgggtgcttgccgggtcaaacgtgctgcttctcgacgaaccgacccgtggcgttgacgtcggcgcgaaggtggaaatttacaacatcattaatgagatgacggaaaaaggtggcgctgtgctcatggtgtcatcggagcttcccgaagtcttgggcatggctgatcgcattttggtcatgtctggtggacgcatcgcaggcgaactgccagcgaagggaacaacccaggacgatgtcatggctctagctgtttcccaggtggatgattccatcaccgaggaagctgctgcagaaatcgaaaacacaaaggaggaccgttgagcaccgccgtagtttcacagaagaagtccacaacggcatccaaaattggacattggatgctcaataacggtgcgttggtggggctgattgcactgtgtgttggactttttattgcaacaccccactttctcaccattcctaacctgatcaacatcggtatccaatcggcgacggtggcgatcctggcgttcggcatgaccttcgtcatcgttaccgcaggcattgatttgtctgtgggatcagtggctgcgttgggtgcgatgacctcggcgtatttcttcgcggaagttggtttgccgggctggatcacgctgctgattggcctgttcatcggattgttggcgggtgcgatctctggcatttctattgcttatggcaagttgcctgcgtttattgccaccttggccatgatgtcgatcgccaggggaatcaccttggtcatttcccaaggctcaccaattcccagtgcaccagctgtgaacgctttggggcgcacctactttggcatcccgatgccgattctgatgatggcactggctggcattgtgtgttggtttattttgagccgcaccgtgctgggacggtccatgtacgccattggcggaaacatggaagcagcccgactatctggtctgccagtgaagaaaatcctggtcatggtctatgcactggctggtgtgtatgcagcacttgcgggtctggtcatgacgggacgcttgtcgtccgcgcagccgcaggcaggcgtgggatacgaactcgatgcgattgccgccgtggtcattggtggtgcgtcacttgctggcggaaccggaaaagcaacgggcactttgattggtgccatcttgttggccgtgatccgcaatggcttgaacattttgaacgtgtcctcgttctggcagcagattgtcatcggttgtgtcatcgcgcttgcggtgggcttcgatgtcatccgaaacaaaacctctaagtaattcctgaaaggaaattttcacatgtacgctcgtaaacttattgctctgtccgcttctgtcgttttggctttcagcttgtctgcttgcaaccgtgaatcttctggcaccagcgcagacggcggttctgcggatgggtcgatcaccttggctctgtctacccagaccaacccgttctttgtgcagcttcgtgatggtgcccaggaaaaggctgatgaattgggcgtgaccctcaatgttcaggatgcttccgatgacgctgcaacgcaggccaaccagctcaacaacgctgtcaccaccggtgctggcgtggtgattgtcaacccaactgattctgatgctgtggtgccgtcggtggaagctctcaaccaggctgacattcctgttgtggctgtcgaccgttcctccaatggtggcgaggtggcgtccttcgtggcatctgacaacgttgctggcggcgcgcaggctgctgcagccctggcagaggcgatcggtggcgaaggtgaaatcctcatgctgcaaggcattgcgggatcctctgcatcacgtgatcgtggacagggatttgaagaggagatcgctaagcatgagggcatttccattgtggctaagcagaccgccaactttgaccgcggtgagggcctggacgtggcaactaacctgctgcaggcacaccccaatgtgaaggcgatcttcgcggaaaacgatgagatggcgttgggcgcaatcgaagccctgggtgctcgtgctggtgaagatgtcatcgttgtcggtttcgatggcaccaatgatggtctggcagcggttgaagatggacgcatgttggccaccgttgctcagcagccagaagagctgggagcaaaggctgtggaagaagcagctaagctcctgcgcggtgaggacgctgaaacagaggtaccagttgaggttgtcactgtgaagctcgacaacgtcgcggacttcaagtagtcggcgatgaaaaagtccggtttactaaaccccgatctgtgttacgccatcgcgcggctcgggcacaccgatacctgggcagtggcagattgcggattacccatcccagaacacgtagagatcatcgatttggcactcgtgtttgggatccccacctttgaacaagtactgaatgctctcaagccggaagtagttgtggaaggcgcggtgattgccgaaggggcacccgaacgtatccgcgaaatggtggatacggatgtggaagttgtcacgcatgaagagctgaaagcccagctcgcggaatgtgcctttgtcattcgaacaggggagaccactgcgtatgcgaatgtgatcttcaaatcaggcgtagctttctaagaaagtgtcgttttttgtgcacctgttttgcggcgccccaagcgctgcaaaacgggtgcattttgacgtcgaaaagcaatgaatttaatgcttttaacctggattttctctagaaataggacaaaacgcgattctatgactatattcatctcatgcaattcgcacaaaacccgcgtctgacgaacgacgcggtgatcttagaaccactgtcacatcagtggactcaggatctccaggaagctgtcgcctcacaagaattgtggcgccattggttcgtcgctctacccaccccagagggcatggcggaggaaattgaccgccgcctagccgaacatgcagacggactgtgtgcgccttgggcaatcatttccgctgcaacaggccgtgccgttggcatgacctcatttcatacccttgaccacgcgaataaacggctggaaattggacgcacatggatggctgcccatgtccaaggaaccggcatcaacccctcggtgaaattcctgcagttgcagcgcgcttttgaagacctcggtgtcaatgccgtggaattccgaacgaactggcacaaccaccgctcccgcgccgcaatcgaacgactcggagcaaaacaagacggcgtactacgcaaacatcgcatccaccctgacggcaccgtccgcgacaccgtcatctattccatcaccaacgatgaatggcctgccgtcaaactgacgctcatggagcgactgtaccgtcacatgcaggttcccatcattcccaacgaggcatcgcttttcgacgccagctagcccctttgttcacccaaaccggcgcttactgtgaattcatcattcacaatgggcgccggttttttctatttgggatcggtggtttgcgttttaggaggcgacttcagtagggaatcgggactttgttgactgaagtcgtgtgatgagaagttgagcgcgcgaagttgagggggagaagtcgcctattgggggttattttcgatgcccgatcacagtaatctcgaacaggttaggtaaggtttgcatactttatttttatcctgaagggacgggcgccaatgaaaaagcgtgtcagtttatttaagtcagctgcatcgattgtggtggttgcgggaatggcgttgggtatggtgggttgctcatcgaccgaatcggagagtgaatctagcgctgacgtgacatcatctgccgatggggcatatccagtgtccatcgcgaccaaattcggtgatgtcactgtggaaagccaaccagaacgcgtcgttgccctgggttggggagatgctgaggctgcgctggaattcggtgtgcagcctgtgggtgcatcagattggctcgcattcggtggtgaaggcgtgggaccgtggattgaggattctgcctacgatgaagcgccagaaataatcggaaccatggaaccggagtatgaaaagattgcagcgcttgaaccggatctgattttggacgtgcgcagctctggcgaccaggaacgctatgacaagttgtcttcaatcgcactgaccatcggcgttccagaaggtggcgatagctacctcaccccacgcgctgagcaggtaaccatgatcgccactgctctggggcaggctgaacgtggtgaagaagtgaacgctgaatacgagcagctcactgctgatattcgtgcagctcacccgggctggcctgagaagaccgcggctgctgtatctgcaacggcaaccagctggggtgcatacatcaagggctccaaccgtgtagatactttgctggacctgggcttccaggaaaaccctgagctggctaaacagcaacctggcgatacgggtttctccatcaaattcagtgaagagactttcggcgttgtggattccgacctggttgtcggctttgccatcggtatgactcctgaggaaatggcagagcaggttccatggcagatgttgaccgccactcgtgacggccgttcctttgtgatgccccgtgagatttccaatgcgttttctttgggttccccgcagtccactcggttcgcgttagacgccttggtgccacttctggaggagcatgcaggggagtagtggtccggtggtgcgggcagggggtagcggtcgaattatttgcctgtgggcataattttgagacaaaataatagaaacgtctcagatgttgggaagttcttcacgctatcagttagggagcacatgagtactcaagttgaactcaaaacaccgaaatcggaagaccgggcagcatatatcgctgcattgggattcccggtcttggtcatcattggcggcatcatcggattcacagcctcggatgttgtgctcaatatttcttcgtgggtcaatcctttgctgggcatcatcatgttctccatgggcctgaccttgaagccagttgacttcgcccttgttgctaaacgcccactcccagttcttatcggcgtgatcgcccagtttgtcatcatgcccctgatcgcattgctggtggtctgggttttgcagctgcctgcggaaattgcggccggtgtcatcttggttggttgtgcacctggcggaacttcctccaacgtggtgtcttacctgtcccgtggtgatgttgcgctgtctgtcaccatgacttccatctccacgctgcttgctccaattttcactccactgcttaccctgtggctggcggggcaatacatgccacttaatgccgctgatatggctgtatccatcgtccaagttgtgctgatcccagtcgtgggcggacttgttgtgcggttgatcttcccgacactcattggcaaggttttgcctcttttgccatggatttcagtcattgcgatttcattgatcgttgccatcgtggtcgctggttcaagggataaaatcctcgaagcaggactgctcgtgctggctgccgtgattattcacaacaccctcggctactccctgggatacctcgctgcgaaattcactgggcagcctgctgcagctcgacgcactaccgcgattgaggtcggtatgcaaaactccggcctcgcagctggactcgcatcccagtacatgtcaccaatgtctgctctgccaggcgctatcttctctgtctggcacaacctttccggagcacttcttgctgcattgtgcagggcgtccgataagagggctgcggagaaggtggcttcagaaaaggctgcctcggagaaggccgcttcctaaaaggcttcgctcctaaaactctttaagagtcaggccaactagcccgcccggttttctcgtgaaaatcaggcggtctttggcttttctaaagtgtttctaaagccaccttcgacctcaattaagcagcaatccgagccgggggagcgctgtcagaaatggaccgtgccaccccatgacaacatgcttgcacaatgatgactagaataatgacccatgactgcagccttttatgatctgatggacttcgatgaagttctagagaaatatgacccggtgatgggacttgaggtccacgtcgaactgggcactgagaccaagatgttctctgcatcttctgcacactttggcgctgaacccaatagcaatgttgacccagtttctttgggtctcccaggcgcacttcctgtggttaacgccaagggcgtggagtgggcaattaagattggactggcgctgaactgcagcatcgctgagtcctcacgctttgcacgtaagaactacttctacccggatcagcctaagaactaccagatctcccagtatgacgagccaatcgcatacgacggctacctggatgttgttctggaggacggcaccgagtggcgtgtggaaatcgaacgcgctcacatggaggaagacaccggaaagctcacccacctgggtggtacttctggtcgtattcacggcgcaaccgcttctttggtggactgcaaccgtgcaggcgtccctttgattgaggttgtcaccaagccaatcgaaggcgctggcgctcgcgctccagagatcgctaaggcttatgtctccgcactgcgcgatctggttaaggcgctcggtgtgtccgacggccgcttggatcagggttctatgcgtgtcgacgccaacctgtccctgcgcccgatcggccaggaggaattcggcacccgtaccgaaaccaagaacatcaactccctgaagtccgttgagcaggccatcacctttgagatgcagcgccaggctcaggtactggacgacggtggtgtgattgatcaggaaacccgccactaccaggaggcagacggaagtacctccaagggtcgtccaaaggaaaccgctgaggattaccgttacttcaacgatcctgacctgcctccagtgattgcgcctcgtgagtgggtggaagaaatccgcgcaactcttccagagctgccttgggttcgccgtgcacgtatccaggaagagtggaagctttccgacgccgagatgcgcgacctcatcaacgccaacgcgctcgacctcatcatcgagaccgtggaagcgggtaccactcctgatgaagctcgtgcttggtgggtttcttacatctctcagaaggctaacgagtctggtgtcgagctcgatgctctcggtgttgcgccagctcacgttgctcgcgtcgttgcgcttgtttctgaaggcaagctgaccaataagctggcacgtcaggctatcgacggcgttattgctggcgaaggcgatgtggacgcggttgttgctgctcgtggactggaagttgttcgcgatgacggcgcaattgaaaaggctgtcgatgatgccttggctgcaaacccagacatcgtggagaagtaccgcgctggcaacaccaaggtcaccggcgccatcgttggtgctgtcatgaaggcgacccgcggtaaggctgacccagctcaggtgaaccagctgatcgcaaagaagttggcttaagctttttgccgttgagctgctaaaagtctcgcattaaaggactgcttcccttcgggggagcatttctttttaactaattacttgacacgtcaagtaattagggtctagtgttgtgttcatgatcaaagaactgctcaacaagctcttcggaaacaagaaggcttccccggcaatgacacaatctgaaaccatttcacacaaggagaacaacacaatgaccacttacaccatcttcggccgcggcaacatgggcaccgcaatcgcaggcgtcctcaccaagggtggtgcaactgtagaacacatcggttctgcagattctgacatcgcaaccatcaacggtgacgttgttatccttgctgttccttacccagcagtagagtccatcattgcaagccacaaggatgctctcgcaggcaagaccgttatcgatatcaccaacccacttaacttcgagaccttcgattccctcgtcgttccagttggttcttctgcaaccgctgagatccaggctcagcttccaacctcccgcgttttgaaggctttcaacaccaacttcgcagccactttggctaccggaaaggttggcgatatcaccaccaccgttttagttgcaggcgatgatgaagacgcaaagaacgctcttatcaccgacgtcaacgctggcggcctcgacgcccttgacgctggttccctcaagcgtgcacacgagcttgaagcagttggtttcctgcagctcacccttgcaggttccgagaagattggatggaccggcggattcggcctggtcaagtaacacccagcctcaaaagcactgataaaagcagtcaacccacctcgggttggctgcttttttgcatccagatgcacaaagccgtggcacaaacgagacaaactgagcacaatggctgtcatggcatatcaaccagcagacaatcgctatgacgacatgatctaccgcagggtgggaaattctgggctgaagcttccggcaatttcgcttgggctgtggcacaacttcggtgatgacaagccgctttcaacgcagcgcagcattattcaccgcgcgtttgataggggagtcactcacttcgatttggctaataactatggacctccagcaggttccgcagagaccaactttggcaggattttgcgtgaggatctcaaaagccaccgcgatgagttgatcatttcttccaaggcgggttgggatatgtggcctggaccttatggttttggtggttcccgaaagtatctagtgagttcccttgatcagtccctgactcgcctcggcttggattacgtggatattttctatcatcaccgcccggatccagatactcctttggaagaaaccatgtacgcattgcgtgacattgttgcgtctggaaaggctctttacgtgggtatttcttcctacggtccagagctcacagcggaggcggctgagttcatggcggaggagggctgcccgcttctgattcatcagccaagctattccatcattaatcgttgggtggaggaaccgggcgatgacggtgagaacttgttgcagtcagctgccaacaatggtcttggcgtcattgctttctcaccacttgcgcagggcctgctcacggacaaatatctcgatggaattccagagggttcccgcgccagccagggtaagtccctgtctgagggcatgttgaacgtgaacaatattgatatggtccgcaagctcaatgacatcgcccaggaacgcgggcagtcacttgcgcagatggcgcttgcatgggtgctgcgcgagcaaggagagtacggcgcggataccgtgaccagtgcattgattggtgcttcgtcagttgagcagctggacaacagccttgattcactcaacaacttggagttttctgacgccgagttggaggcgatcgatgagatttcccacgacgccggcatcaacatttgggcgaaggccaccgattccaaaacccgcgaaaactaacccatcaacatcagtttgatggccaatgcggtcatcacaactgccacgacgacgttgatccagcgccacaccttggggctggacagcgggcgtgacaatgctgctgcgccgaaacccaccagcgggaaccagatcaggcttgccgcgaacgcgccagcggcgaaaatccaccgtccggtgtcgccgtattgcgcgccgacgccgccgataaacacaaacgcgtccaaatacgcattcgggttcaaccaggtcagcacgattgccatcaacatgggctttacccaaacccgctgcttatcgacgctcacctccacccgcacccggttgcgcgtgtcagtggccaccgccgaaccgcccaaaggcgtgtcatcgggcacggttggttctgtttcttcaatgatctgtggcgcttccaccttgtttgtcatggcgtctttcgctgccatgacggcaaaccataacaggtaagcgatgccaccccagcgcataatatcgagcacgatcggcgcggcattggacaaaagatcaacgcccaaggtgccggcgatgaacaaaaagacgtcagaaattaaacacacgagaagaaccgcaatgagtccttcgcgcttaattccttgtttaatcaccagtacattctgcggtccgatggacagtaaaagactggcccccaaaagcagacctgtaatgaagatttccatgatcaccatcgtgacctatggaagtacttaagtaaaatgattggttcttaacatggtttaatatagcttcatgaaccccattcaactggacactttgctctcaatcattgatgaaggcagcttcgaaggcgcctccttagccctttccatttccccctcggcggtgagtcagcgcgttaaagctctcgagcatcacgtgggtcgagtgttggtatcgcgcacccaaccggccaaagcaaccgaagcgggtgaagtccttgtgcaagcagcgcggaaaatggtgttgctgcaagcagaaactaaagcgcaactatctggacgccttgctgaaatcccgttaaccatcgccatcaacgcagattcgctatccacatggtttcctcccgtgttcaacgaggtagcttcttggggtggagcaacgctcacgctgcgcttggaagatgaagcgcacacattatccttgctgcggcgtggagatgttttaggagcggtaacccgtgaagctaatcccgtggcgggatgtgaagtagtagaacttggaaccatgcgccacttggccattgcaaccccctcattgcgggatgcctacatggttgatgggaaactagattgggctgcgatgcccgtcttacgcttcggtcccaaagatgtgcttcaagaccgtgacctggacgggcgcgtcgatggtcctgtggggcgcaggcgcgtatccattgtcccgtcggcggaaggttttggtgaggcaattcgccgaggccttggttggggacttcttcccgaaacccaagctgctcccatgctaaaagcaggagaagtgatcctcctcgatgagatacccattgacacaccgatgtattggcaacgatggcgcctggaatctagatctctagctagactcacagacgccgtcgttgatgcagcaatcgagggattgcggccttagttacttctgaaaaggttcagggtttttcacttcttcgcccgcaggaattgggccaggcagagtaacaccttcagcaaatggggatccgccgagcttttcacggccgtgtggtgtcgcgaaaccagacagatctggtccgactggaacgatccgggtggggttaatctccgcgtgggtgatgtagtagtgctgcttgatttcggtgaaatcggtggtgtcgccaaagcctggggtctggaaaagatcccgcaggtagccccatagattcggcatttcggtgatcttgttgcggccacacttgaagtgtccgtggtagacggcatcgaaacgcacgagggttgggtagaggcggatatccgcctcggtgatgtgatcccccatgaggtaacgtcgcgtcgataagcgatcttctagccagtccaacgcaacccaaagccgcttgtacgcctcgttgtgcgcttcctggctaccggcaaagccggtcctgtatacgccgttgttgacctcagtgaagatgcgcttcatcaccggcgccatctcctcgcgcagctccgcggggtagaggttaggcgcaccctcacggtggaactgcttccactcaagattgaaatcgatggtgatggaagggtaatcgttggtgacgaccttcttagacgattcctccacgagcgctgggacagtaatgccgcgcgggtaatcggggaagcggttgaaatacgcgtcctgtagacgaggaatctgcagcacgggatcaagatggtttggatctaaatcgaaagtccaggaacgaacgtcgtgagtcgggccggtcagaccaagcgagatcacgttctccaggccgagaagacgacgggtgataacagtgcggtgtgcccatggacatgcgcgggcagcgactaaacggtagcgaccagcctcgacaggccaatggaaagtgccatcttcctgagcaattggttcggatcccgctggaacgtctgcgacgatgcggtcatcgatgtagttggtatcgcgaacgaactcgccgtctgctgatgcattttgtggggcgcctgcccaatcggatgacgtgttagccactgtgtggtgtcctctcttggaaatttagatgatatgtcaacaatattacgaagtggaatgaaaatcaacgattgaacaaatgttcggggtgattgcagacgtgtcctgcacagttgatatggtgtgaaaccatcatggctcgatcacaaaaaagaacacctgctatcaggtcaaccaaaaaagttaaaagtgtaatatccagcatcatcacgattgccgtggctgcagtcgcttttgcagcttacgttatagatggtggggtagaagaggcgtctggaacaccgacgtcttcggaaagctcggtagcggcaactgctccagcggcatctagcgagactgcggctgaataccgtgcgatgctcgcttcccttgacgttaaaggtcgtgcgccaggaacaggatatgaccgcgaattattcggaccagcatggaccgacactgtttccgtggaatatggacacaatggctgcgatacccgcaacgacatcctgcaacgcgacctggatgacatccaacttcgcgaaggcaccaaggattgtatcgtcacgagcggcctgctcagcgatccattttctggcgaacttattgatttcgttcgcggtgaacgttccggcgacgtgcagatcgatcacctggtcccattacatgacgcatgggtcaagggagcacagcagtgggatgagcaaactcgaaagaactttgccaacgatcccgacaaccttctcgccgttaaaggtacgcttaaccagcaaaaaggtgcaggcgatgcagcaacctggcttccaccaaacacagcttttaggtgcgattacgcaaagaaaatcatcaccgttaaagatcgctacaacgtgtgggtgactgaggctgaagcaagcgccctggaacgccaattagatacgtgtgctgcataacagtcacataagcatttggggcgcgccgaagttatatccacattgcggaagttaattcgcatattctggggcacatgactgataactcgcgaaattcaaatcagaattttgatcaaccagacctgaacgatctcgatgatgattcggccatccctacttacaagggaccatcgccttccgcgaattcctccaacgctaccgagcgcctcggcagtgtttacgaccgaactggccgtgcagcgccccagaacattccgccggcatcaaatgctgctgaaaccacagcatttgagcgtccagataatcaatctgcgaagccagtggcttccgaagctccaacaactattacgccggcaagctctggtgcattagcatccgatgctccgacgtcttatgttcaggcgcagccttcccagcagcagactcctcagcaagttccgccagctccgccgacacaagttactcgtcagattagccgtcctgaagagcctggttaccagccagaaccgtcttattcggagccttacactgactctgatttcgcgccagcaggtgcggccgctgcggcagctgcagtagctccaccaatgattgcggaacagccacaaattgttgaagatgcccgccgaggtaccctcgatttcggcctgttgattatccgcgcagtcattggtgtctatttgatcgtccgtggagtctttacattcttcacccttggaggatctgccggtcttgctggcctcgaggcagagttcgctggttaccagtggcctgaaatcctcgcgatcctgcttccatctattgaacttgcggctggtgtcttcctgctccttggtctgatgaccccagtggcagcagcggtagccacggtggcgacatcctttaccacccttcaccaagtcaacactcatgaaggtggttggggtgaacttagtgagccattgatgctggcactgatcctcactatcgtggttgtcggacttcagttcaccggccccggcaagatttcccttgactctggccgaggttgggcaaagcgtccactggtgagctcgtggatcttcgtggtcatcggcatcgcagcggcagttctgctgtggtggttcggtgcgggtgtgaacccaatcgcgtagccaaagttttagaaaaagaccctcctggtgagggtctttttcatgcctgggttcggtttggggcatggtgctgtagaaggctgtttaaggattcgtaattgcctaatgggtcaagtgtggggagaggtgtttgaggcgcttaaacggaagaatagggcctatccactttggggtcagtggggtagttgtggttcctgaaagcttccagggcaaggatccaccacaaacagggctttgccctttggaatcggtccgaaagttgcacgcatagggctataaagcgggaaaatccaccacaaccagcagaaatcctgcaacttgtggtgagtatttgcaacggggagctccaccacgcccacacaggccaagacatgaaaaagcaccggaacccaaagtagggaaccggtgctcaaacactcacaaagggttagtcgacctgacggactgcacccttatcagcggaggtagccatctttgcgtatgcgcgcagtgccttggtgacaacgcggttacggttgactggctgccatggcttctcggaggcgttcatagcgtcgcggcggcgctggagttcctcgtcggagacctgaacttcgagcttgcggttgtgaacgtcgatggagacgatgtcgccgttttcgatcagaccaatgactccgccgtgtgctgcttctggggagacgtggccgatggacagtcctgaggaacctccggagaaacggccgtcggtgatcagtgcacacttcttgcccaggccggatcccttgaggaatgcggttgggtgaagcatttcctgcatgcctggtccacctgatgggccttcgtagcggacgaccagaacttcgccagcttggatggtcttggtcaggatgacagagactgcctcttcctggctttcgacaactcgtgctggtccggtgaagttccacagctcttcttcgatacctgcggacttgatcactgcgccgtcaggggagatgttgccgcgaagaacaaccaggccgccgtcggcggtgtaggcgtgttcaacgtcgcggatgcagcccttggcagcgtcggtgtcgagttcgtcccagcggttctcggtggagaatgcttcggtggtgcggatgccacctggggctgcgtggaagagttcggttgctacttcggtggtcttgccagagcggatatcccagtcatccaaccaaccttcaaggtcgttggagtgaacggagtggacgtccttgttcagcaggccaccgcggttgagctcgccgagcagtgctggaatgccaccggcgcggtggacgtcttccatgtggtagtcggagtttggtgcaaccttggacaggcaggggacgtttttggacagttcgtcgatgtctgcgaggtcgaagtcaacttcgccttcctgggcagctgcgaggatgtggaggatggtgttggtggatccacccatggccatatccagtgccattgcgttttcgaatgccttcttggtggcaatgccacgtggcagaacggattcgtcttcttcaccgtagtagcggcggcacagttcaacgacggtttcgccggccttttcaaacagtgcgcgacgtgctgcgtgggttgccagagtggagccgttgcccgggagagaaagtcccagagcttcggtgaggcagttcatggagttcgcggtgaacataccggagcaggagccacaggttgggcatgcggatgcttcaacggctgcaaggcctgcgtcgtcgactgcatcgcttgcggatgcggagatcgcggtgatgaggtcggttggtgcgtgtgcaacgccgtcaacgacgacagccttgccagcttccattgggccaccggaaacgaagaccactgggatgttcaggcgcattgctgcgttgagcatgcctggggtgatcttgtcacagttggagatacacaccatggcgtcggcggtgtgtgcgttgaccatgtattcgacggagtcggcgatgatttcacgggatggcagggagtacagcatgccgccgtgtcccatggcgatgccgtcatcgacggcgatggtgttgaattcctttggaacgccaccggctttgcgcactgcatctgccacaatatcgccgacgttcttaaggtgaacgtgtccgggcacgaactgggtgtaggagtttacgatggcaacaattggcttgccgaactcattttccttggtgccggtggcacgccaaagggcgcgagcgccagctgcattgcgaccgacggtggtgacttttgaacgaagtgggatcatgatgcgcttttcaaatctgctctaaagagcggcgggtggttgtcaagaatcaacggcactttgaaaacttgggtgagcttctactcgtgcagaggtgtggacctttggttcggacggcttattacactctagtgctgtgacgcagggttatcacgatgtgaggtttcagacgcggcttgtccggtctcttgggattcaacgctttctgtttgtgttgtattcccatcggtgtcgtcatcgaagttcaactgaactggcttgcccagtgccttttggcgctccaagtactcttccttggacatcatcacggagtagccgtcttcttgaacgactacaaccttgccgtcggctgcttccttgcttgcggtgatcgcatcggggatgcggccgtgggaagcagcttcaaggcggggaagggagttgaaggtgacgccggggagggtgacttctgcatcggaggtggtgcgagcgaaagtgcgggcacccttgaatccgattcctgcgaggtcttcccaggccacaacctttttgcccttgaaggcgtagtttgcggtgatgccctgttcatcaacgatcgtggatgattttagaacccagtaaccgaagatgacagggagcgcgagcagccaaaacaggtactgaggggctgcgccgatgactaataatgagatcaggccaaaaacaacggcgcccaaaatatgggtgcgttctgggtgaaatttttcggaaagctccacggatgccttttctgcgtctgaactcataatttccaatagtagtaaagaaatgggacacgtctgtaatcagcgtcctaaggggtggacgtcggcgcaactgtctcttggaccgcggttggtgcttccactgctggagactgcgtctgcgacgcagtcgtttcctcctgcgacgtggcttcctcggtcggttcgatggtgtcggctcgctggggcgttgcggttgcaggggttgaggtttcctgctgcgtttcgacgttagattccatcgttggggtctcctccaccgtagtgggcactgtcatcgaaggcgtgcttactggcgcggaagtttcggaggtggtcaccgcagttgaggtggcagtgcttggtgacagccatccactggagttttgccaattctcacttggttccacagtcatgaccttaaatagtgacagcaagagcagcgcacccaacaacagggacgtgctcatgcggacacgtccgccaaacgacaggatcttctgccaccgatttgggtagtaatcagtgcggaagaagcctcggagagagtgatctggttttgctgtttcttccggttcttcgctggagagttcttgttccagcacatcggaatcaagttccttctctggattgcctgcattgatcaccgaggcgtctgcattgtctgcatcgtcgttagaggatgcagctagcgatgcaaccgtcgccgcagcctccggcttcggttccttaagagcctggggggaggcgtcgataagcgaggtctttggctcttcatgctcaacgtgtaaggaatcaatgagggttcccgatgtagtggttgcgctgccgtattcttcccagaattcgctgatgatttctgtgcggatggcgcgttcgaccagccattgattgccggcggtgacttgcacgaggaaacgcatggtgaccatccacggcatgccgaccaccgttggcggcgtgacttccgtggctgggtgcacatcgagttcaccgaggatttccggtgcgattttctcctggccaagtgcgcgacgagtcgcagcttcagagcgcgcgatgacatctgtgatgttttcagaacccaacatggggatcggaataacgacaaccgcacgcgaccagttattagaattgttgatgcacactttcgccgtggagttggggatgatcacggtctcttgtgcaatcgtgcgaattttggtcgcgcgcatggtgatctcaatgacggtgccttcgacaacgatgccgttgccctcaaaacgcacccagtcacccacgccgaattgcttttccgtcaggatgaaaaatccggccaagaagtccgcaacaatcgactgcgcaccaaggccaatggcagctgacgcaatggttgccggaatcgcagcgcccgcgagagagaaaccaaaagcctgcatcgcggagacggcaagcatgaaaaacgccacaatttgcgcgatataaacgccaacgccggcgaacgcgagctggttcttagtggtgtccgcatcggctgcagactccactcggcgcttgataatacgcatggccagtcggccgatacgtggaatcaaaaacgccaagaccaggataattgctacatcaaaaccggtatcgacaatccaattccacaatgaatagagcaaatattgaatgggtacgcctaaaatcatgagccaagattagcgctgaaaagtagcgggagcctgcctgaactttgtgagaatcctgattccttaaccgaagtgggggagttttgggggtgggaattttcgtgcgttgtggaattggaaactcgatgtgtgtagcatgacacaccatgaccattattcgacttgtagtagtaaccgcgcggcgcctgccgtaacggccttccaagtcgtctcgtcaagcgccctcgacaacactcaccacagtgttggaacgagggctttcttgttggttatgacccaagtagccaactttgcaacagacatctgtcgcactgcgtgcacacgcatccgcgtcggaacaattttaaatgagggctttgtctttaggctgagttgaaatcggcttggcttggacgggtcctgtgaaaatccttatttagtaaaggagccagaaagtcgtgaatgtggcagcttctcaacagcccactcccgccacggttgcaagccgtggtcgatccgccgcccctgagcggatgacaggtgcaaaggcaattgttcgatcgctcgaggagcttaacgccgacatcgtgttcggtattcctggtggtgcggtgctaccggtgtatgacccgctctattcctccacaaaggtgcgccacgtcttggtgcgccacgagcagggcgcaggccacgcagcaaccggctacgcgcaggttactggacgcgttggcgtctgcattgcaacctctggcccaggagcaaccaacttggttaccccaatcgctgatgcaaacttggactccgttcccatggttgccatcaccggccaggtcggaagtggcctgctgggtaccgacgctttccaggaagccgatatccgcggcatcaccatgccagtgaccaagcacaacttcatggtcaccaaccctaacgacattccacaggcattggctgaggcattccacctcgcgattactggtcgccctggccctgttctggtggatattcctaaggatgtccagaacgctgaattggatttcgtctggccaccaaagatcgacctgccaggctaccgcccagtttcaacaccacatgctcgccagatcgagcaggcagtcaagctgatcggtgaggccaagaagcccgtcctttacgttggtggtggcgtaatcaaggctgacgcacacgaagagcttcgtgcgttcgctgagtacaccggcatcccagttgtcaccaccttgatggctttgggtactttcccagagtctcacgagctgcacatgggtatgccaggcatgcatggcactgtgtccgctgttggtgcactgcagcgcagcgacctgctgattgctatcggctcccgctttgatgaccgcgtcaccggtgacgttgacaccttcgcgcctgacgccaagatcattcacgccgacattgatcctgccgaaatcggcaagatcaagcaggttgaggttccaatcgtgggcgatgcccgcgaagttcttgctcgtctgctggaaaccaccaaggcaagcaaggcagagaccgaggacatctccgagtgggttgactacctcaagggcctcaaggcacgtttcccgcgtggctacgacgagcagccaggcgatctgctggcaccacagtttgtcattgaaaccctgtccaaggaagttggccccgacgcaatttactgcgccggcgttggccagcaccaaatgtgggcagctcagttcgttgactttgaaaagccacgcacctggctcaactccggtggactgggcaccatgggctacgcagttcctgcggcccttggagcaaaggctggcgcacctgacaaggaagtctgggctatcgacggcgacggctgtttccagatgaccaaccaggaactcaccaccgccgcagttgaaggtttccccattaagatcgcactaatcaacaacggaaacctgggcatggttcgccaatggcagaccctattctatgaaggacggtactcaaatactaaacttcgtaaccagggcgagtacatgcccgactttgttaccctttctgagggacttggctgtgttgccatccgcgtcaccaaagcggaggaagtactgccagccatccaaaaggctcgagagatcaacgaccgcccagtagtcatcgacttcatcgtcggtgaagacgcacaggtatggccaatggtgtctgctggatcatccaactccgatatccagtacgcactcggattgcgcccattctttgatggtgatgaatctgcagcagaagatcctgccgacattcacgaagccgtcagcgacattgatgccgccgttgaatcgaccgaggcataaggagagacccaagatggctaattctgacgtcacccgccacatcctgtccgtactcgttcaggacgtagacggaatcatttcccgcgtatcaggtatgttcacccgacgcgcattcaacctcgtgtccctcgtgtctgcaaagaccgaaacacacggcatcaaccgcatcacggttgttgtcgacgccgacgagctcaacattgagcagatcaccaagcagctcaacaagctgatccccgtgctcaaagtcgtgcgacttgatgaagagaccactatcgcccgcgcaatcatgctggttaaggtctctgcggacagcaccaaccgtccgcagatcgtcgacgccgcgaacatcttccgcgcccgagtcgtcgacgtggctccagactctgtggttattgaatccacaggcaccccaggcaagctccgcgcactgcttgacgtgatggaaccattcggaatccgcgaactgatccaatccggacagattgcactcaaccgcggtccgaagaccatggctccggccaagatctaaacagcaattaatctgattgcacctgctgcataaatgtgactagtcaaacaccgtctaattacatgtgtgtggtagaacaataatgtagttgtctgcccaagcgagttaaactcccacgatttacagtggggggcagacatcttttcaccaaaatttttacgaaaggcgagattttctcccatggctattgaactgctttatgatgctgacgctgacctctccttgatccagggccgtaaggttgccatcgttggctacggctcccagggccacgcacactcccagaacctccgcgattctggcgttgaggttgtcattggtctgcgcgagggctccaagtccgcagagaaggcaaaggaagcaggcttcgaggtcaagaccaccgctgaggctgcagcttgggctgacgtcatcatgctcctggctccagacacctcccaggcagaaatcttcaccaacgacatcgagccaaacctgaacgcaggcgacgcactgctgttcggccacggcctgaacattcacttcgacctgatcaagccagctgacgacatcatcgttggcatggttgcgccaaagggcccaggccacttggttcgccgtcagttcgttgatggcaagggtgttccttgcctcatcgcagtcgaccaggacccaaccggaaccgcacaggctctgaccctgtcctacgcagcagcaatcggtggcgcacgcgcaggcgttatcccaaccaccttcgaagctgagaccgtcaccgacctcttcggcgagcaggctgttctctgcggtggcaccgaggaactggtcaaggttggcttcgaggttctcaccgaagctggctacgagccagagatggcatacttcgaggttcttcacgagctcaagctcatcgttgacctcatgttcgaaggtggcatcagcaacatgaactactctgtttctgacaccgctgagttcggtggctacctctccggcccacgcgtcatcgatgcagacaccaagtcccgcatgaaggacatcctgaccgatatccaggacggcaccttcaccaagcgcctcatcgcaaacgttgagaacggcaacaccgagcttgagggccttcgtgcttcctacaacaaccacccaatcgaggagaccggcgctaagctccgcgacctcatgagctgggtcaaggttgacgctcgcgcagaaaccgcttaagtttcacccctttgacggcttaaccgccgcataggaaatgccctccggactaattgtctggagggcatttttgctacctgctgtgcactttgtacataaggcaacaagattttggcaaaatggtggccaaaatcaggaaatcttggtgccgaaagtacgcgcggaagaaaaaggccacccttttcaaagggcggcctttaaaagacgtgttagaaactagtgctccagcagatgcagcatccgcttacgcagggctgtggtctcggcttcaacagaagcgtcttcactcagctcgtgtctggggcggggaagattcactggaatatcggtgatgatggtggcttcggggctcttggacatcacgagaactcggtcggagagcaggatggcctcgtcgacgtcgtgggtgaccatgacgacggtgcggcgggaggcttcccaaatgttgagtagttggagctggagttcgcggcgggtgagggcgtcgagggcgccgaagggttcgtcgagaagcatgattggtgggtcgatggcgaaggcgcgtgcgatgccgactcgctgttgcatgccgccggagaggcgggcggggcgccgttcggcggcgtcggtgaggcctacttgttcgaggtgggtgcgggtgatgtcggcgcgttcggttttgctcaaggaggggcgcgcggagcggaggccgaagtcgatgttgccgcgtgcggtcaatcagggcaggagggcgtggtcttggaaaaccatgcctcggtcaggtcctggtcctttaatttcttcgttgcctgcgctgactgtgccggtggatggggaggccagtccggcgatcattttgagaattgttgattttccgcagccggaagggtcgaggagggagacgaattcaccgtcgttgatggtgatgctcgtatcgccaatgatagtggtggagccgtaggacttggtgatcgtattcagctcgacggaagcgtttggtttagtcatagcgaactactttctgcaactcaccgatgaggtggtcaaggattaagccggtgatgccgatgattacgacggtccatccagcaacgtggcaggctggttgaggtatttttcctgcgacagcgtgcgtgccgaggaatcaaattgtgccggattgctcaaaattgcggaggcttcctccagcgcattaagcacaccctgagccgccgtggggtgttcagctttccactctttggccatcgccacggcgcagcatggatgtttgtcccacagttgtttggtcagcagccaaatccggccggagccattgctgatggcgcgttcattaaacggcccaggcccaatgaatccatcgatgccctcaactgtcaattgtgcgaccatatcggcaggtcggagcaggcgaagctcaagatcggcgatgggatcaactgcgtttgagacgagataatcgcgcaggagcagcgcatggactgaatattcaaaaggaattcccagcaccatgcctttaagatccgccgctgaattgacggaaccatagtgctttgacgccaaggtaattgcttgcccattggtgttctgggtaaacgacagctccgtcgggcgcgacgcgttggtcactccagcattaatcgccacagtcatcggcgacagcatgtgcgcaacatcaagctgctctgttgcataggcggtccacaggtcggaccagcctgagtacttcttcaacgtgacattcacgccgtgtttcttaaacagccctagcgcatctgcgatagcaatcggcgccgagcccgcaataggcacgtagccaatggtcaggggagtgttatccgcaggttcattattgcttgtcgacgtcacgtagcgggccgctccggccaatgcggtgctcaaggacgcaaaagcgcccagttgcagaaaacgcctgctgtcgaagaggatatgtgtcacgattgcagcatccttaaatcaggtgccataccgagtgttctttgaatttgaataggctagtctgtattcattaggcgatgtcttgtgagattagtaaatggccacagctctagccccttatccacttgactccccggttctagaaaaagacctcatcgacacagtggttgctaacgcaaaagctgtagacaaagcagaacttgatgcccgctacatcctgaaactccttgcggagcaggggaagatcagcgttggagccctcgcaacaccgacggtagcctcttggaaatggcgcgcatcgtgcgtgagctttcccgctaggacctgtctactgccttcactttgtgcgaacaccgcatgaccttggattacttcaaggcatccggcactgactatgctttgggattggctgcagagtcggaaggggcacgacgcactggtatcaccggcatggcgagtgcattcaaggagtttgctggttgtggtgagatcgaccttgaagcaaccagggtagaaggtggcctcaaagttagtggaaagcttcgttgggcttccaacttgtgcgaagatccagtgattgtgcctgctgcaaagaccgcagagggcttacaactactgttcgcattgggcgcagaaaccgaaggtgtcaccctcggttcttcacttgctctactcggtttgaacgcaactgcttgcgcttgggtgagctttgaggatgtcttcattcctggggctcagattctaagccacgatttccttaccttgtggcatcggtgcgcccaaccttcgtgatcctacggatctccgaatacttcggtgtcgctgaagctgcgattaatgcagccactggacgtctgaccagcctcagcgaagtgtttatcgacaacgctgccgagatccaagacaacctttcttcgctggtcgcgcttcagaaagatttggcagagcgagtcaacgttgaaggagtcaatcctgttactccagttgatctactggaacttcgcctcggttccgcgcagctggccgttgctgcaactgccattgaggttcgtgttgctggaggagcaggttatgtaaagtcttcatcaacgtctcgtcgtttccgtgttgaaatgggagcttgcacgggtccgtgatctacaggccacgcaaaactaaatcactttaaatatcaacaccctgttcactgtctggtgctttttgggcagcggatggggtgtttgttcttcttattcaagtttttggaaagataattaactatgactttaaaaacagtaaacggaacgcagctgcgagacactgtcggatcgttcccttcaggtgtcacggtggtcaccactaccgatggggaagtggaccacgggttgactgtgagtgcgttcgtgtccttgtcgttggagcctgccatggtgttggtgagtatcgataagaaatcaagcgttgtgccgtttttggagcagggttcaccagttgctgtgtctgtgttatcggaagagcagagcgatttggccatcacatttggccgtcatctggaaaacaaattcgacggcgtttccattaagcgttcaacaaacagggcagcggtcttggaaggtgcgtcagcatggttgagtggcgctgtggtggataaatacccaggtggagatcactttattatcaccattgccgtggaagagtgtgctcacgacgaggagcaaaagccacttctttaccaccgtggcaggctttttcagtggcaagaagattaattctccaccccttcattttcaataagctttcaataaggggagaagtgtgcttagctggggtcatggaaagccacgatcttcagcagcgcagttatgcgcacaatcccgatggccacgaccacagccatgacggactcggacactcacatgctcccagctccctcaaggctctttttgcggtcatcattttcacctcgatcatcttcctagcggaactaatcgccggccttatttccggatctttggcactgctggctgacgccatgcacatgctgtccgactccactggcttgatcattgcggctgtcgccatgctcattggccgtcgggcacgcacttctcgtgcgacctacggatacaagcgtgcggaagtcttggcagcgatggttaacgccaccgttgttacagcactgtctgtgtggatcgtcgttgaggccatcatgcgtctgggcaaggacctggaaatccagaccaacctgatgctcatcgtcgcggtcattggttttgtcaccaacggaatttccgccctggtgttgatgcgccaccaagatggcaatatcaatatgcgtggagcattccttcacgttctcagtgacatgctgggttccgttgccgtcattattgcgggcctggtgattcgctacacgggatggatgccggccgataccattgcttcgattgcgattgctgcgattattattcctcgcgcattcagcctcctgaaggaagctctcaatatcttgttggagcgtgttcctacaggtgcggagcctgcagaggtcgacgcagcccttcgtaaagtcccaggtgtcagcgatgtgcatgatcttcacatttggagcattgacggcaaggaaatcctggccacggtgcatttggtggtggattcgtctacaaatcagctgcatagttgtggcgtgttggatcgggcagaagcggaactatccaaacttgggatcttgcactcaacaattcagctggaaagcgcagatcacagtgatcatgaaagtgtgtgctgatatagagtatgtcccatggggttttccacaccaagctatccgctaaatgatctgttcgcccgcattgaccgaggcgatatccaacttcccgattttcaacgggattacgcttgggatgttgatcgcatccgaagccttataaccactgttcttcgtggttttccagtaggtgtgctgatggcactagacacccgcggcgaggaaatgcgtttccggccacgcgcgctgtccggcgccccagatacgggcaaggatccaggtcttttgcttctcgacggacaacagcgcctcaccaccctttatcattgcttcagtggcgatggctatgtaaatacggtggacttccgatcaaagaaagtgacccggaagttttatattgatgttgctaaggctgttgaatctccggtcatgtccgatgaggctattttttcagtcgacgaaaccggcaaaatcatctcccacttcggtccagtgatcgacggcggcatcaccgatttagaaacagcacttgctcatggttgccttccagtttctgtgctgctggatgataacggcactgatttcctctttgacctcgccgatatggcaggagaaggcgctcgcgaacacgcgaagcgcttccaatcacaaatcgttaagaccttagttagttacgacatcccaatgatccgactggatcgtgaaaccgccaagggtggaattggttccatctttgctcaggccaatagctctggcttgcagatggatgtctttgatttgctcaccgcggtgttcgcagccgatgaatcggtggagaccgaattctcactgcgtgatgactgggtgcgggttgaacgaaaccttcgccaacactccgcacttgatggcatcggcagcacggagttcctcaccgcagtagccctgttggtcagtgcccgcaagggacatgcgtctggttaccgtgaagatatcttgaacttgacgctggctgaatacattcctgctgccgatgaaatgatcaagggcttcgacgaggcggctgaattcctgcgtcagcgatgcattttgagtctcgaccaggttccatacaccgcgcagattgttccactggccgtgatcctcaccctgcttgatgcagaagaaatggccaccgcacgttcatgggatcgtttgaatcagtggttctggagcggtgtcttgggtgagctttatggctcgcctgctgtgatcgcacgttccggtcgcgataccgatcaagttgctgcgtggattcgtgaaggtgccggcgaaactgcggttgtgccaaagactattcgcgataccgttttccacgaatcacgtcttctcagtgcaacccaagacaccggagtgtggaagggtatcttcgcactgctcatgggcaggggagcacgcgactggcgcaccggacagcagtttgatcgctggacttttgatgagctgggttgcaatttccaccagattttccccaccaaatggtgcaaggaacgcggcatcgatcctgtccttacggaatcagtactgaaccgcaccccgatgggtcgccgtaccgaagtagtcatcggcgatacccctccatcccgctacctgtctcgtgttcaatccaagtcgctcatgggtgatgaggaattcgatcagatgctggatacccacctgctcagcgcggaagacctgcacagttccaacaccacgcacttctttgcttctcgacgcaccaacttcatcgacatggtcgaggatgccatcggtaaagcggtgatcagggacgtcaacgagtcagatctcaccggtggacacgatggtcccgatgcatttggagacgctgccgaggagtagtgtccacctgctcggttaggattgaccgaaagagtacttcaacctttaggacatccatttgacacatcttgtttctccggtacgtcgcattattgcagcaaccaccacagcagtggtggcgctaggcctggtttcctgttcaacggacagcagccaggaaggcgccaacggtgctgcggaggtgatggcggagggcgcgtcgacaagcgaagttgtcgacgattcgccctaccgcgaagcgcgcgctgaaaacgtggcgcgtgtggtgtcggaggattttccgagtaccccgacggtgatcagtgacgccgactactccggaatcaaggctagcgagttgttttttgattcctctgacaatgttgttgtcgctggcaatggtattgcagaggagctgcgcgcggcctcgatcggtgtggttgcgcatgcgccggttctgcatgcgcgcggtgataataacgccgcagtcatggcggaaattgagcgtctcggcgcttcaacggtgttgttgattggcgatgcgctgccagaacttgccgaggatgagacgatcaccaaagtcattcatgacgacggtaccgaagaaggattagcgcagctcaccgctttgcaatttgagacgaaacaggttgacacggtggaggatctggttcgggaaaccgccagcctcacccctgaggatcaaacactgctcgcacctgcatggggtggtgtggcgccgacgccttccgacgacaagctggctgccttcccgctgcagtccaaacgtgacggtgaaatgtcgccgatcgtgattgccagcccagaatctggaatctccgctgtggcgactgcgcgtgcattcggcgcagaaattcgattcatggattatcccgacccgcgattcaaccaagagcagatgaagatggttgccggcctggctgatcgtcctttgcttgcactcggtgatcaatttgggaccggcgaacagctcgcggaaaagatcaagcgtggggaagaagtaaccactgaactacccggcggtggaggacttgttttcccaggtcgacgcatggtggcactgtacggacacccatccggaccagctttaggcgcacttggtgaacaaccagccgccgaagccgtggcgcgcgcgaccgacatggctgcgcagtaccaagagttcgaagaccagcccgtgattccggcattcgaagtaatcgcaacggttgcctctgaattcgcaggcgacgacggcaactactccaacgaattccccgtggaagatctagtcggatacgttgacgccatcaccgaagccggcggatacgcagtcctggatcttcaacccggacgcgccaacttcctcgaccaagccaaaatgtatgaagaactcctcaaacgaccaaacgttggattggcgctagatcccgagtggaaaatcggacccgatgagcaacccatgacacgagtgggctctgcagatgccgccgaaatcaacgaagtatcccagtggctcgccgacctgaccgccgagaacgatcttccacaaaaggcatttgtactgcaccaattccaattggaaatgctcaccaatcgggatcaaatcaataccgatcacctggaactggctgtcgtgttgcacgcagatggacacggaaacgcaggggataagtacgcaacttggaacatgcttcgcgagggactgagcccgaactacttcatggcgtggaaaaacttctacgacgaggatttcccgaccttcactccgcaacaaacctatgaagaggtcgatccgcgaccatggtttgtgtcgtatcagtagtttcggggagcttcgggctcgcttgttggcaatgtgagcggtgagttagctttcgaccaaaccacactgcccacgaatcctagaaatgggatccgtgggcattcgtgtctggtttaacggccttgaaaccggacaggattgcccaaagtagtcgaatttccagttcgtgggcatgtgtgtttggtcaggtttagtcgggtcgaaaaatgaactcggaatcggtaaaaagtgacctcacagaatcgcttctaagggccgttcaaagtgttgcctatacaaacacatgttctgactgcccgacctcttaaaatggcgttaaatggcgcgaaatggaaaacgcctcgtggcctggatggagcgttagtacgagaccagtacgagaccagacacacgtgacaaaaaatcctgaaaagtggaatcattgtcacgcctgtctggtttagctctggttcgggacgggcgtggaatggaggcagtgcaccgagaccttgacccgcggcccgacaagccaaaagtccccaaaacaaacccaccccgccggagacgtgaataaaattcgcagctcattccatcagcgtaaacgcagctttttgcatggtgagacacctttgggggtaaatctcacagcatgaatctctgggttagatgactttctgggtgggggagggtttagaatgtttctagtcgcacgccaaaacccggcgtggacacgtctgcagccgacgcggtcgtgcctgttgtagacggacattcctagtttttccaggagtaacttgtgagccagaatggccgtccggtagtcctcatcgccgataagcttgcgcagtccactgttgacgcgcttggagatgcagtagaagtccgttgggttgacggacctaaccgcccagaactgcttgatgcagttaaggaagcggacgcactgctcgtgcgttctgctaccactgtcgatgctgaagtcatcgccgctgcccctaacttgaagatcgtcggtcgtgccggcgtgggcttggacaacgttgacatccctgctgccactgaagctggcgtcatggttgctaacgcaccgacctctaatattcactccgcttgtgagcacgcaatttctttgctgctgtctactgctcgccagatccctgctgctgatgcgacgctgcgtgagggcgagtggaagcggtcttctttcaacggtgtggaaattttcggaaaaactgtcggtatcgtcggttttggccacattggtcagttgtttgctcagcgtcttgctgcgtttgagaccaccattgttgcttacgatccttacgctaaccctgctcgtgcggctcagctgaacgttgagttggttgagttggatgagctgatgagccgttctgactttgtcaccattcaccttcctaagaccaaggaaactgctggcatgtttgatgcgcagctccttgctaagtccaagaagggccagatcatcatcaacgctgctcgtggtggccttgttgatgagcaggctttggctgatgcgattgagtccggtcacattcgtggcgctggtttcgatgtgtactccaccgagccttgcactgattctcctttgttcaagttgcctcaggttgttgtgactcctcacttgggtgcttctactgaagaggctcaggatcgtgcgggtactgacgttgctgattctgtgctcaaggcgctggctggcgagttcgtggcggatgctgtgaacgtttccggtggtcgcgtgggcgaagaggttgctgtgtggatggatctggctcgcaagcttggtcttcttgctggcaagcttgtcgacgccgccccagtctccattgaggttgaggctcgaggcgagctttcttccgagcaggtcgatgcacttggtttgtccgctgttcgtggtttgttctccggaattatcgaagagtccgttactttcgtcaacgctcctcgcattgctgaagagcgtggcctggacatctccgtgaagaccaactctgagtctgttactcaccgttccgtcctgcaggtcaaggtcattactggcagcggcgcgagcgcaactgttgttggtgccctgactggtcttgagcgcgttgagaagatcacccgcatcaatggccgtggcctggatctgcgcgcagagggtctgaacctcttcctgcagtacactgacgctcctggtgcactgggtaccgttggtaccaagctgggtgctgctggcatcaacatcgaggctgctgcgttgactcaggctgagaagggtgacggcgctgtcctgatcctgcgtgttgagtccgctgtctctgaagagctggaagctgaaatcaacgctgagttgggtgctacttccttccaggttgatcttgactaattagagatccatttgcttgaaccgccttcccatctttgaattcattcaaggtggtaaggcggttttcgctcttttaatacagttttaaaggtagatttgggagagaagatttcccttaagaaaggttcttaacaaccatgccgcctgcgacgctgttcaatgttttgacttcagctggacttgaccctcaccagtcaggtgatgccattgttgtcgagtctgcccatttcacattgacgttcacgtgggatgagtggctgcgagctcaagcgacgtgggtgggggagttgagtgcgtcggattatgtgcgttctattgtggcgattaactctgcccatgatgcacgggcaacgccgaagatgatgttggatgccccgactggtctgacaacggtgcttaaggcggataagggtcagttgcaggcgtttgccgtggaggcgctgccgattggcgatggcctcagcgaggctcagttggcggggtttgtggctgccgcgtttgatggcgccatcgacctcactcgtgagtttcatgcactttacccggagcgctcgccgcaggagcgcggcgcaatgctcaacattaagcttgtcgacgcctccccctctcaaacagttacgcccgtgcgagtagctaactggttcatggatcagggggtggaggaagttccttatgatgcagcttctgggcgcatcagctttgagctgggtgacaccccagtggatgtgattttggatgatcccgagttgttgaagatccaagccgtggtggttgctgaccgcgatgtggaagccactgaagttttacatttgtgtaatcgagcgaacctggattctgatcactccaccatttttatgcgttcggatggggatgatgtggatttcgtcgccacggttgcggtgccgattcgtgctggtctgaacgatttccagttgagtcaagccctgcatgatggggtagtgggggttgttgggcaggtacgagctgtgatcaatcagctacactagtgaagtccatatagtgagaagggaatcccacaacatgaaacttgctgttattggtggagatggtatcggcccagaggttactgcagaagccctcaaggttctaaacgctgtccgcgacgacatcgagaccaccgattatgaccttggcgcacgccgttacctcaaaaatggcgagctgctcaccgacgaggatctggcatccctgcgcgagcatgacgcgatccttcttggcgctatcggtgcaccaggttccgtccctccaggaattctcgagcgtggtttgctgctgaagatgcgattcgcactggatcaccacgtgaacctgcgcccatccaagctgtacgacggcgtggagtccccactgcgtaacccaggcaagattgatttcgttgtggtccgcgaaggtaccgaaggcgcctacactggcaacggtggagcaatccgcgtgggaacccctcacgagattgccaatgaaacctccgtgaacactcgctacggcgctgagcgcgttattcgctacgcattcgagctggcacagagccgccgcaagaagctcaccctcgtgcacaagaccaacgtcctggttcacggtggtggcctgtggcagcgcaccgtagatgaggttgcaaaggaatacccagaggtagccgtcgattacaaccacatcgatgcagcaaccatctatctggtcactgatccttcccgcttcgatgtgattgttaccgataacctcttcggcgacatcctcaccgatgaggcaggcgcagtctctggcggaattggcctcgcagcatccggcaacatcgatgccacgggcaccaacccttccatgttcgagccagtccacggctctgcaccagatatcgcaggccagggaatcgcagacccaacggcagcaatcctatccgctgcgatgctgctgcgtcacttaggtgatgaagacaacgcagtacgtattgaaacagccatcgcagctgatgtggctggccgagataactctcagccgatttctaccactgaggtgggagaccgcatcgtcaaggcgctgcaaagctaaatttcaacgccgacccccttgccttttatggcgaggggtttacttttcggtatgggttgaattggttggtgtaaatacttgctggattgatatcggggacgtcgtattggcggtcaatccagtgggaccacatgctgaactccctatcactgagcactccacctcgggttgcgatgcccgaatgctcccaatatctaaagctggatattctatcactctgaccatgggcttcgaggtagttgaaataaacttcgcgcacttcttcaggggagtgggatcgttcaaactcgattgcctgagctactccatccactaattctccaaccactgcggggtgctcgtcgatgagtttttgcgacaccaccatgcagccagtgttgagttcctgcacaaggtctgaatcctctgccaagatccgaaaatctccagtttcaagcgcttggtgtttagcgctatcggtgacccaaattgcatcaacttgcccctggtagaggcgttgttctaagtactcaccgggtaatgcacgttgagtgacgctcacgatctcaggttcggtgagaccggcgtcgaatagatgacgctcaaccatcgcagatcccagagcaccgagggtgtttatgccaactgttttgccaatgagatcgtgcacttcgtgtatctcactgtctttaaggactagaagtgcagaagaagaatcgtgggaaattccgtaacttgcggccactgctttgatgggcgcaccggtggctatctctcctgcaacaaggccaatgaaggggactgccgcgaagtcaatgtcatcctttttgagcgattcaatggactcaacgccgccttgtacagatccgactacttggagctcaatgttgttcaaatacccaagcgcaactgctaattccacgaagtttagattgaaatcagagacctgataccgcagcacagtggattctttagtgtaggagtcaggaggctctggaacgcatgacactaacaacgtgatgccaaaaagtacgaaaaaagtacgaatgaaagtgaagctcatcgaacgttgatgcatggaagttactttcgctaaagcaatataacgcactttaacatatttccccccatctttttgttctcaaatttatttgtactcgaatgcaggatttcgagacaatgaggcagtttttcttttatggttaatctcatgtcggtcgaactcgaagaaatccgcgatttcttagcaggatttgaacctttcgcgcagctaccagccgaggaactagatcagttacctggaaaaatgagcttgcgctattttcggcgtggggaagagatcatcccaattggtgtgcccaatcattacatgggggtaatcagatcgggtgccattgatgttcttgatcaggagggcgtactgctggatcgccgtgacgcggggcgctcgtttggctattccacgatggggccagaacgaaattctcggtaccgtatggttgccgtggaagattccttggtgttgcgtctggggcgtgatgattttgatgagttagccaagcgcaaccctgatctgaaccgttactactccagctggtcgaagcgtatccgcgccgctgctgatcaattgcgccaagaatctagttcgaaggtgctgcgcacgaagttgggggagttcaagatcgccaacccgatttcctgcagcccggacaccacgatcatggatgctgccatcaagatggatgagttcggggtgtcttcgttgctggtgcagatcgatggggaactcaaaggcatcatcaccgatcgcgatatgcgcagcagggtggtggcgaaggatttggatattcagctgccggtctctgaggtcatgacggtggatccgcgttgcgcgacctcgcaggggttggcttttgaggccatgttgttgatgtcggagctgcgcattcaccacttgccgattgtggatgatggccaaatctccggcatcgtcactgcagctgacatcatgcgcttgctgcgccacgatccgatttacctcactgcggatctgtcgcgaaaaaataccgtggaggaattggccaacaccttccagtcggcagcggaggtggcttcgagatttattgatcggggagcttctgcggaagaagtcagtagcttgctcaccgtggctgcggattctttggcaagaaggctccttgtgctggcggagcggaaatttggtgcaccgccagttccgtattgctttgtggtggtgggctcgcagggcaggaaagaaatgggactggcctctgatcaagacaatgcccttgttctggacaattcctacaatgaccgcgagcatggacagtattttgcagcgctgagtgaattcgtgtgccagggcctcgaccgcgcaggacaggtgctgtgtccgggtgacatgatggcatccaatccggagtggcggaaaactgctgaccagtggatctccaccttccattcctggattactgcgccggagccggatgcgttgctgcatgcccagacattctttgatttcaggggaatttacggcgacaccgagatggctaaggatgtccaccaaaatgcggtgaatatggccaggggtgcgcgtcgcatgcatgcacacttggctagtcttgcggcccggcgcgatcctccgctggggtttttccgtggtcttgtggtggagcgttctggtgaatacggcgcgacgatggatattaagaagggtggcaccgcgggcatcgtgcagatggcgaggctgtatgcgctggccacgggtagtgatgcgattgggactcgggagcggttgattgctgcgtcgggccatggtcaggtgtcgcgtaagggtgcgcaggatttgttggatgcctttgatttcttagcggcgatggcgttccagcaccaggcgcggttgatcaaggtgggggagaagccgaactatcacattgatcccaagacgttgggcaagatggatcgggagcatttgcgcgatgcattttccattattaaagatatgcagtcggcgttagctactaaatatccggtgaggaacatctagtgttggggcgtcgaaaagcgaaaatacggcgcgcaaccggcgcgttgcaggagttttattccgtgccgcggccgggggcgtcgacacgcattgaagacctgaagcttctggctgtggacgtggaaacgacgggcctgaagccccaccggcatcaaattgtgtcgattgggtgggtgccgattaacggcgacgtgattgatctgagcggcgcggggtatgtggtgattcgcggcagcgaggggttttcggtcggctcgtctgcggtgattcaccagctcaccgacgatgaaatcgccgcgggtatcgacatcaaagaggcgcttggccaactactgcaggcgctccagggacgcgccatgctggcgcatttttcacccatcgagcgcgattttatttcggccgcatgcctcaagcatttcggaacgcttctcgacgtccccctcgtggatacttttgccatggaacgccgccacatggagaggatgtccacctacccacgtggcgaagacctccggcttgcacgcattcgacaacgatatggtcttcccaattactccaatcaccaggcattaaccgacgctttggcgtgcgccgaggtgtatttggtgcagatcacgcaccttcgggcgaacaccctcaaagatatttgggaataggggtcatcgtgcaggcccccacacccaacgcgtaacataacggtcatgcgttttggacgaattgccaccccagatggaatgtgtttttgctcaattgaaggcgaaggcgatgatgtagctaacctcaccgcccgtgagatcgagggtacccccttcactgaaccaaagttcaccggtcgcgaatggccacttaaagatgtacgcctgctggcaccaatgctgccaagcaaagtcgtcgcgattggccgtaactacgccgatcacgttgctgaggtgtttaagaagtccgcagaatcactgccaccaaccctgttcctgaagccaccaacagctgtcaccggaccagagtccccaatccgaatcccttcctttgccaccaaggtggaattcgaaggtgagctcgcagtagttatcggcaagccctgcaagaacgtcaaggctgatgactggaagtctgtcgttttgggcttcaccatcatcaacgacgtctcctcccgtgacctccagttcgctgacggccagtgggcacgcgctaagggcattgacaccttcggccccatcggaccatggattgaaactgacatcaactccatcgacttggacaacctgcccatcaaggcacgcctcacccacgacggcgaaacccaattgaagcaggactccaactccaaccagatgatcatgaagatgggcgaaattatcgagttcatcaccgcctccatgaccctgctcccaggcgacgttattgcaaccggttctccagcaggcaccgaagcaatggttgacggcgactacatcgaaatcgaaattccaggcatcggcaagctgggcaacccagttgtggacgcctaaaatggatcaccaccatcacgatcatggggagaagcgtccgtacgaccaggtcaccccagaatccatggagaatcaatacaccaccacggaacaagtctggagcggcaaccccaaccaagcactcatcgcctacttgggtgaagagccagctgaaggcaccgcactagacattggctgtggcgaaggcgctgacctcgtgtggctgtcctccaagggatacgtcaccaccggcatcgacttcgcaccaactgcagtgaagcgcgcgaaacaaaacgccccatcagccgaagtcctcttggtatcattcaccgaattcgccatcgaatccggtcgccaattcgacctcgtcagctgctcgtacggccaaatcccagccaacgacacctccgtcgcgcaactggaaaacctcgtcgcacccggcggaaccctcctgttcacccaccacgactttgaatcagaatccgcagcaaccccaaagtggctgtcggaaaacctgagcgaagccttccgtgtcgaactagtggaatccttcgaacgtgacatcaaaaccggcgctggcgcacaccaccacgtggacattgtgctcaaggcaacgaaggttgattaaggtttttagtgggtttttgaggccatccgggattactcgggtggcctttagtcacgtttggggtctctattaagggcttatggtgacttgcggggctttccgaagcgttaagttcgatttcacggtttcggtttcttatgctcaataccttccgctcaatttctcaagctcaatttcagtcggaaaatggggtttttcctagcgaaatcgccgttaagaaattgagcgcgggaaattggaattgagaaaccgctcccatgaactcgccaatgagaaatcgtcaccgagaaatcgaacttaaggaggggagagctcccctaaacccagctgcggaactgatacagctcgatttctcatgtgctgacttcacgtgctcaacttctcatcacacgacatcagtagtgaaagcccggaatccggagtgcagtctgcccacgagaagttgagcgtgagaagtcagctcacgtgaagtcggtgttttaagaccacatctcacaaaccaagcgagcgcatgatggtttggagcttcgcggtggtttcatcaaactcttcttgggcgtctgattcggcgacgatgcctccgcctgcccatgctctggcccaggttccgtcttcggatacttcggcgcagcggatggctaccatgtattcgccgtctccggtggagtcacaccagccgactgctccggcgtagaagtttcggggggattccgcttcgatgatgagggcttcggcggcgtcggtgggggtgccacagatcgcgggggtggggtgtgtgcggatggctagttctagtgcggtgatgtgtgggtacttgagggtgccaacgatgggtgttgcgaggtgccacatttcgttggttttggtcagttcaggaactgttggggcgtcgaattgtgagcacagtggttccaggatggtgcgcaggtggttgaccacgtaggagtgttcttctaggtttttggcgctggccaggaggttttgtccttgggcttcatcgcgcactggatcggcaagccgtggtgcggagccggccagtgggtatgcggtgatggtggaaccttggcgtttgattaacacctccggggaggatccaaccagcatgtggcctgcaaagtctgggcctgcaggggtcaggtcggcgatgaaaccgtccttgttgtgggagttatcaatcaaacgtgcggccaccagcaggggatcaacgggtggctcgaaggagatgtccacggcgcgcgcgagcacaactttgttcaggacagtgttgttgatggtattgatggctgcattgacgcgtcgtaaatgctcaatcggtgagggatcaattcctgcgacgctggcgtgcagtactgagcctggtccaaacctgtagtaggcgtgaggttctagggggccgtcttcgcggatgatgtgttctgggacagtcagtgctgctggtttgtcccgttcgaagggcaaagcacccaccaccatggctacgcgcccttgtttaagggcgtctactgcctcccagggatcggtgaatacttcttttgatccttgggtgcgcacagacccgtggcctctggataagaggaaatctggggcggtgttgggggcagaggggttgcggtgggcagacatggttagccattctaatcccagtagaactggggtaaacgcgcgggcggtgggtgcgggctattaacatggcctgcatgactgatgttcgtgttcgtttctgcccatcgcccaccggcaccccacacgttggacttgtgcgcaccgcgctgttcaactgggcatatgctcgccacactggaggcaagttagttttccgcattgaggacactgacgctgcccgcgattccgaggagtcttactccgccatcatcgattccctgcgctggttgggaatggactgggatgagggtgtggaaaagggcggcccgcatgagccctaccgccagtcgcagcgcaaggacatctatcaggatgtgttgaagcagcttatcgacgccggtgaagtctacccagcttattccaccgcggaagaggttgaggagcgacacaaggctgctggccgcgatccaaagctcggctacgacaactttgaccgtgatctcaccgaagagcaggtcgcagcatttgaggctgaggggcgtaagcctgtgtggcgtctgcgcatgccagagcaggattggaagtggactgacctggtccgcggtgaagttgagttcaagtcgttcacccagcctgacttcgtggttgctcgttccaacggtgagcctttgtacaccctggtcaaccctgttgatgatgcgttgatggaagtcacccatgtgctgcgtggtgaggatcttttgccatcgactcctcgtcagcttgctctgtatgaggcgctcaagcgcattggcgtggcaaaggccaccccagcctttggtcacctgccatttgtgatgggtgagggcaacaagaagctgtctaagcgtgatccacagtccagcctgttcaaccaccgtgacaacggcatcatcccagagggcatgctcaactacctggcgctgctgggttggtcactgtctgctgatcaggacattttcggtgtcgatgagttgatcgctaactttgatgtcgctgacgtgttgggcaacccagctcgctttgaccagaagaagcttgaggccatcaacgcggatcacatccgacttctggagcctaaggatttcgaggctcgcctgcgcgcgtacatgactgagtacaccgagttcccagcggattacccagctgagaagtttgccattgctgcggagctggttcagacccgcatcaaggtgctcagcgaggcgtgggatctgctgaagttcctggtcaccgctgacgaagatctggtgttcaatgagaaggctgccaagaagaacctcaaggagaccgctgttgagcctctcaacgccggtatcgcagcgctggaggcagtggaggagtggaccactccaaacattgaagcagcattgaacaaggctctcattgaggatctaggcctgaagcctcgcgtggcgttcggtgcgttgcgcattggtatctccggcgaggctgtatccccaccactgtttgagtccatggagcttttgggcaaggaatccacgttggttcgtctgaaggttactcgtgagcagaccccattcgtggtcgctgagtaaaacctgtagatgaacaaaagcccgtctccgttcagaatttctgagggaggtgggctctttgcgtttcgggtttagttgtggagggaggcgtcgtaacgcaaaatgtcgcccggctggcagccgagctcgcggcaaatggcctccaatgtgctgaagcgtatcgcttttgcgcgcccgttttttaagaccgagaggttggctggggtgatgccgattttttcggcgagttcgccgacgcccattttgcggcgggcgagcatgacatcgatgtcgacgatgatggccatttagatcaccgattccagttccgtggagaatccgatggcgcgggccaggagtgcgcgcatgatttttaccagcagggatacgcccgtgatgagcatcgcgaggatgagaccgaagacgatggctccgggggcgtcgtcgacttctgcgacgatgtaggccattgggaggagtaaaacggcgccggctgcgatggtgatggcaattcgatcaacccaggcgagcgagtgggcgtcgaagatttcatcgtcttccacgagacgcagtagcgcgaacagacagacgatgatgaactgcacgagcccgaaaccgatgatcacgaagctcgcgagaatggtgagcgggatgggggagagctcgccggagttgaggccatcgcgcacgattttgatggcgagcaggacttgcagcaccaacagtgcgaggaaggccgcgccgaaaatgatgcgaagcagcatgaggatgcggggattcatggggaacctttcagacatgcgccgtggatgggcgtatcgtttcaagatgtaaatctatcgaaaaacgatatgtctacgcaagcttaaaacccccacgttatgtaggggttggaggtttactcggcttcgatcagtgctttcaactggcggtttgagttctctttgatcctgctgatgctggccaaaaagggcactccgggggatagtacgccactaaaggacattgattgatccacctcagtgcgaccatcttccaaaggcttcagctcgatcgtgtcggtgacggtgagcagccaacgcgcaacaattttggtggaccacgtcaattcacggtgtggacgcagcacgtcgatggtggggcgaaacttcaaagtgaggcgattggtctctgggtgccttgttttcatcttgagcttcatgccctgctcgatctcaccaggcgcctgcacgtacagaatgtgctcattccactccggcacgcggttggtctcctcgatgaaatcccagaccttttccaccggcgcatcaatctcaatggaattatcggcgcgcagcggaagtgcacggctgaccgcccaagaggacaaagctgcaattcctgtccagaaaatcagcggcaacaacagtgctggaaacggcattgggggagtttcccttcaacttcggggcttagtagaggccggataggggcttgcgatctccccacagcttagcgcctttttgctcagccttggtcgaatacttgtgtgtcaaatgcccgcgcgccgatctcccacacgccatccgcgggggatccattgttggggccggcgaatcgggcgtcgatttccaggatggccatgccgtgcgcgaatgcccacagtgcttgacccttgatcggatcgtggccggtgaccaggtagaatggcgttcctgcccaagtttctaggccttctggaagtagctcgcgggggaactctgaactggtgagaagccggtaaatatttggattttcccgagccatggagcggtattccgcaagcaaatcctccacactttcacaatgttcatgcaggctttgccccagctgaataaatgccttcgtggcgatgtgtgcggcgatatcctcgcgcgtttttacatgcttgtacagcgacggcgccttgatatttagctccgcggccagggttcgcatgctcacattcgcccagccacgtgtttccaccaaccgccacgcggtatcaataatttccgctaggcggccagggggggatcgggaaaaatcactgctctttagactccacaaaatttgcaagtgctttattggatgcctcaaatgatgcccccaaatccataaacagtggggcaaacatcccgagaatccccgtaaaactctccgactgcgtcaccttcgtgctctcgcctgcaggctccagcacaaacgaatggttgccgtccatcagcccgggaaacgccacatgtcccagccagcgcagctcgcgggcgggttccgccgcgaggatggtcggagtagagcttatcgacgaacccccctccttgtttgtaaacgccacggtgttcccaaccaccgcttcaccactgaaagacgtgatggtgggatgtcactgcgggaagggctctagatcactcaacacctcccacacctgatctggttgggcatcgatggtgatttctctggtggtggttgcaggtaagagctggcttaagccaaaggagagtgcaggtagagctatgacaaggccaagtgcgatgaacaagatgcgggactgcttctttgttttcatgagctttcatctctggtgatgtgttgggcaactaatctccgggctaacggtgttggctaattttggctagagggtatttcctgcaattttctaacccggcaacctgcagatttggccgtattgcatggttgtggttatagtattcctcgttgaacagcgcgccatgcgagttgcttggagcttaagttttaaacattggcctatggtgtaattggcaacacaacggtttctggtaccgtcattctaggttcgagtcctggtaggccagctgcgatcagctggataaacaattgatcgtgtcctaatgccccgttcgtctagcggcctaggacgccggcctctcacgccggtaacacgggttcaaatcccgtacggggtactccgcatcatttatttgcggtaagtttttaaatgttttacaaggtttacaatcttgaaaaacgattggcctatggtgtaattggcaacacaacggtttctggtaccgtcattctaggttcgagtcctggtaggccagctgcgatcagctggaaaacaattgatcgtgtcctaatgccccgttcgtctagcggcctaggacgccggcctctcacgccggtaacacgggttcaaatcccgtacggggtactcttaaaagcatccacccttcatcaattgagggttggatgttttgtgtttgctaacacatctgacatcaccccctcccaggacaaatgtacgggctcatgtagcaggggattttaaaaatgcgggggtgaaagatctccagcggttgcggagttaaatcgcaaaagcctttaccgagattcggtctcgggttaaagtcaggttcatacagagaagttcatagccgatcaccaacaagttgttgctctaaccagcacaaatgcaactttggaggcttcggaaagggcgctctggagtcaatggaaccgaccagtaaaaggagagtgtatggcagtaagtggaatgaaaaagaagttcggacgcaatgacgccgtcctcccggcagctggcatcgccataaccaaagattccaagcgctagagatgcgtgaatcaggagctcgccccgacatgacacatcgttgcagtcaactgacacccaacttctccttcttcaacaacccacactcggcacattaagcccgcagcgggcaacagcggacgcaacgacgagaacaattaactcgagttgacgaaacctccgcaccgacgccggaaagcggtggcagcaggttgaagccactgtgaggagttgagagggtcagtcagagaactacacaacgacccttataagcccagacaccttcattcgaaaccattattcgaaagagggtgtcgttacaggttttaggggcctcttatcttcattgggtatcgtcacagtgtggattatgggcagtttgggggagtgctcgaaatggggcctgggagttcatttaagcagtagcgccggaatactttttcaaccagagcgtgcagtaactcaataagatctccacgcaattcgagctcgatgcccgcaggcgcgatttaagaactgttctaatacttgtggctttgaattttgctgaacgtcctgcaaatcaaaaaacaagccatgcggaagtatcggtattcgtcatttcacgaagagataacgacaactagcgatcaccgactctgagatctgtgctggggcacgccataatggggcttatccatcacggatctagttaaattccaggatgggaaaccggagccgctaagaaattcttcatcagccaatgtgcagaagttacttcgcgacggtgaattcttgatggagcaagttgttggtctgggcgcagagctgcatgccctaggatgtgaaaacccaacgttgatcgcgatgggcaacgttgttttctaggcattgtccaaaccggatgtgattgatgagctcagagcaaagctcggttcagatacaagggctgtcaaagtaacgcattactcgaaaggcgctggaatttatcacgatgactatatggcacgagtttttggagagctgaagcatcatgggatcatgtggggtgcggaagggtctaggtgtttttacgggtttataactcactggaaaaaagtcacctgacctcgttatttgtatgaatagcatttcgtggtttattgttattgagtcgtaaaaacacgaacaagccccgttcgtctagtggcctaggacgccggcctctcacgccggtaacacgggttcaaatcccgtacggggtacaatcgaagaagccactcagtgaatttcactgagtggcttcttttttcattgggtaactctatcgacttcagaacattctagatagaacatggttatagataaggagtgtctcacgccttcaataaaggtgttgtgctgactccatcaacaaattgcaccactcgagatcaaccattcagagcgcaaatggaagaacgagcactgcaattgaaagcgcaagcaatccaaggtagttaattcaaaatgcctgtccaaggaagcgcgctcgtatatgagcaacggcaggaattaagaaataggcgatcactccgatgttggctgctagggcaatatcgggtatccaaatcccagcgataagtccagttgcagggagtagtttgatggcaattagtgtccaccaccaatcgcgtgggggagccggcacgctgggtatgttcgctctcgatcatcgtgtcgaaaatctagtactactagtgcatttttgtcgcctactgccattaactgtttcagtgcttacaccagctaattcagcgattcctcgaattgttatggcagcaaagaccagttcctggaaaagttgcactgcagccttgagaacacgtgcctgcgtcgcctgtttaagccgcttgcagttggaatctgctattagtcatcctttgaatgaacatgttcattttagtatcaggttcgagacagagatagcccatcactttcgggaggatttcaattatatggtggccaattacagctagcatgaagcacatgaataactccgtagatcaacaaatcgccctctttggtcaatctggtagtggcaaaaccgccctactttgctctttttatggcgctgcacgagattcaactcaaagtgaaggtcagctatttgaactcagtgcaaaagatgatcggcataccaaactaatgaagatgtatctgggaatgaaagaagattccctagcgccaccccaaaatagattcgagtctcataagactgtcttttccctaaaacagaaaaacatcccaattaaggatgctgctaaatctgatcaggtgaatctcacttggcatgattatccaggtgaatggtttgagggtggagctgtaacggactcggaaaagcaggataaagttgaaacgtttagaaacctgctgggctcagatgtagcgctatttttagttgacggtcaaaagctgcatgattacgccaatgaagaggagcgctatcttagctatttatttgatggattcattgaaaacctaaatcagatcaaagatgcaatcctggagggtgggaaacagctccaacagttcccacgaatttgggtaattgctttatccaaagctgatctatggccagatctccaagtaaaagattttgagaatctacttaataagaaagctggcaatgaaattattgcgctgcgttcaaagcttttggagtttatcgataacgacgaagctttctccttcggtaaagatttccttttgctctcttcggcgaagttcactccaggccatattgatataagccagcgcaagggtgttgatgtcctcctcccgttggcttgtgtattgcccatgcaacgccatttgtggtggcaggagctgaaagttttgccaattaacctggctgatatacttttgggaaatgaaattgcccaaatgggtttcaagatcgtttccaaagttttgaaaaacaaagtatctggaacaaataacaaggcgatggcggcattggttttcgctgaacttgtgagggatatggttgatcagccaactgaattgcttcagaaggctcgtgaggaagccgtcggaaggcgtgaattccttaaagcgattactgcagaattcaccaggaagctgaatcaagccgaagctgatcaggttttagttcgggactttgcatgacactcatgtgggcaacccgtggaaaagactggggtttccgatttcttgatgatggtggggagctcgatccactcctgatctataagcaggcatttgcagaccgcgaattggccggtgaatttgtgctaattcgcccggaattcacggccacgcgcatgtttgatcctctaggacgcaccgaccatgctggccgcataattccacatgactttgtccttcgggggcagttcgcggaaggcgtcaccacattggaggatgttcaggaaattatttggccattggtcgaaaaacgatatgaggctatctgggatcgctctgtctaacgccgataaacctccgcaccaccagcaataaattcccgggatttctcagccatcccctcccgtgccccactagaagcaacagcactagaagaatccccaaccccaggcatccccaattccgcgatttgatcgccaaacatatcgcgaatgtcctggctaattcgcatggagcagaacttcgggccacacattgaacagaagtgtgcggttttcgcaggctctgccggcagggtttcgtcgtgataagcgattgcagtgtcggggtcgagggagagcgcaaactgatcattccaacggaattcaaaacgcgctttactcatggcgtcgtcccaggcacgcgcgccgggatgacccttggccacatctgctgcgtgggcagcgagcttgtaggtgattacgccggttttgacgtcgtcacggttgggcaggccaaggtgttctttcggggtgacataacacagcatggcggtgccacccatggcgatgtgagctgcaccaatggcagaagtgatgtggtcataacctggagcgatgtcggtaactagtggtccaagagtgtaaaaaggtgcgtccgctgcccacttttgttccagctcgttgttttcctggatcatgtttagtggcacgtgtccaggtccttcgaccattacttgtacatcgtattcccaggcgcgttgggtgagctcaccaatggttttcagctcggcgaattgcgcggcgtcgttggcatcggcaagcgatccggggcgtaggccatcaccgagggagaatgcgacgtcatattgtgcaaagatttcgcacagctcgtcgaaatgctcgtagaggaatgattcgcggtgatgcgccagacaccaaccggccataatggatccgccgcgggagacaatgccggtgacacgacgggtagtcagtgggatataagccagcaggacgccggcgtggatggtcatatagtccacgccttgttcacactgctcaatgatggtatcgcggaatacttcccagttaaggtctgcggccacgccatttactttttccagcgcttggtagatcgggacggtgccgataggaacgggggagttgcggataatccattcgcgggtggtgtgaatatcatcgccggtggatagatccatcacggtatcggcaccccagcgcgtggcccactgcagcttggacacctcttcctcgattgaagaggtgaccgcagaattgccaatattggcgttgattttggtcaaaaatttgcgaccaataatcatcggttcagattcggggtggttgacgttgttgggaataatggcccgaccgcgcgccacctcagagcgcacaaactccgcatcaacgtgttcgcgcagcgctacaaactccatttcacgagtaatcacgccagcacgtgcataggccatttgggtgactcttttgccaggtagcgccttcaaaggagctggtttttggcctttccactcagccgaagcttgacctcgacgcattgccgagcggccgtcgtcgataagcaaacgctcgcgcccctgataggtggcaacgtcgccgcgggcggtgatccatgactcgcgcagccgcggaagtccctgcttggggttggtttctgggccacgggtgcggtagatgcggaagggttcgttggggccgcttggcgagtcatcgaggcggatttcggtctccgggacctcgagaccgtccttgcggatgggggagtagctatgtttcgggtggatctcattttgggtaggcgtcattgcaccattcctctcttccttcgccggtgctaaccggacaggttcaaacggtgctcgcgcagcaatcagcgcgatctcagcccgtgctcgggcgcccgtggggactgccttcaaaactagcgcgttgcacgcgtgcgcgtaaaagttacccccttgcgggggttaagagagggcgcttttcgacgcggtgatggtggggtacgcctacgtagtggttctaactcggccgttgcttgcgaatctcagacacccgtgagtggtcttgaatccaattagtggcatctttctcaatccaagaggcgacattaaaaactgctgaatcaaacatattgaggttcctatcgtcgacgtctaaatgtgacttgctgagcggtgataattttcccaggagaatcgtttgttttagttcttcttttggcggttgttagagcttttttgaactgttgagcaaatctaaaatagctatcatcttcaaaccagaaggggccacgagcagatcgtaattgggcgtcaaccctgtttcttaaaagcacttctacatgttgtatatcttctaaatatgctttagataactgggtattccagatgtaaaaaccttcgggattttcagaatttcggtatgtattcattctagggatggagaaccactgttcgagctctgcgatagatgtaggggagttgccagtcacgtcgccaaggtcttacacttaggattcctaagccccggagtgatccctaccattttggtacgtcaccggggctcttgttttttcttcaagcgctcgtctctgatgtcctgaaagagtggctagggtatcggtgaatccatcgacacaaaaggattgggacattataaattcggcttgcatctagaccaagctgtctgctaatgtcgattttacgatcaagaagatcagccgcaagcccttcggcaggctgactggcaaccgcgcatcgcgcacggtgcccccgaaggaagatcggctctgtactcaaaagaatgcagagaagagcgattttttgaaggagattcccatggggaatatttctgctaagcctccattgcccaatagctgcggacatcatttaccaggacacgaaccctactacctacaagtaaaggttttgcgcgaaagggcgacatgggagccagttactaacctgcgtatggatggccagttcgtcgagtttgatgctggtggggaacatattcgtggttggaatcatgatccggctcggatggaatggtttgtaaaaaatggtggtctggctgaatggagtggatctagtccaaccagtcgcctcatgcgttttgagtccaaaaatgggcattacatggtcagtattggtccgaagtacgaccgcaatggttgttatggcaatatttccctggggatagtgccaacaagcccgggcctggattttcacgaaggatttaaacaggctttagaggctttcaagtatgttgagcgggaatatggcactgaacaggattaggtagaaataaccgcgcggtttgatcaggcgcctcccgcgcgggaaactatttttcaggggcacgaagcgcgcttttcgacgaagccccttgccattgtgggaaataagaatgcccaccaacactcgtcgaaaagccctcttttaaaccccttaaccccaaaaaacggctaacccaaaagggttagccgtttgttagaagcggaggttaaaacctacttcttaacagcaggagttggctcgagcttccagatctcggtggcataatcgcggatggtgcggtcggaggagaaacggccggactcgcaaatgttgatccaggccatgcgtgcccaacccaggggatcggaggcgtagtcggcggccatacggtcgcgggtctcgcggtaatctgcgaaatcgccaagcacgtagtaggtgtcgctggcgtcttttccataaccgtggatcaaggaatgcttgaggtcgtagaacaaaccactgttgttgtcgttgagggtgccgttatccagggcgtccaatgcgcgcttgaggccagggacggtctcatagagctcatatggctcgtagctttcgcgcagggctggcaattcttccacgcgagcaccgaagatataggcgttttcctcgcccacagaatccacgatctctacgttggcgccgtccatggtgcccagggtgagggcgccgttcatcatgaacttcatgttggaggtaccgctggcttccttgccggcggtggaaatctgttcggagacatcagacgcaggcaagatgtgctcagcaggggagacgttgtagttctctacaaagaccaccttgagcagcggggagacctcaggatcgttgtttaccaagtcagcaatagagttgatgagcttgataatcgccttggcgcggacataacccggcgcggccttggcgccaaagatgacagtgcgtgctgggatgtcggtgaggccatcttccttaatacggaagtaaaggtctagtacgtagagcgcgttcatgagctggcgcttgtactcgtggaggcgcttaatctgcacgtcaaagatggattctggatcaatctcaatgccctggcgctcgaggatccactcggcgaagtcttgcttattagcagccttgatagcgcggagttcttcaagcacggacttatcgtcggcataggagcgcagcttcttcagctcatccagatcggttacccaatcatcggaaccggaaagtcgagtgagcaggtcagacagacctgggttgatcatgcgcagccaacggcgtggggtaacaccgttagtcttgttgttgaacttctctggccacagtgcgtaccagtcagccaaggtctcggccttgatgatctcggtgtgcagcgctgccacgccattgatggaatatgccgcgtaacaggcaatccatgccatatgaacagtgccgtgctggattggagccatgcggtcgatggtctcttcatccagtccatcggctgcgcgctccaaacggaagcggcgatcgatctctgtgatgatttcccacacgcgccagaacagctgttggaagatctgctgatcccactgctcaagagcttcggtgagcacggtgtggttggtgtatgcgaaggtcttggacacgattgcccaggattcttcccagcccatgtcatgctcgtccatgagcagacgcataagctcagggatagccaacactgggtgagtgtcattgagctgcacggagtggaactcggcaaagttgctgaggtccttgtggtgcgccaggtggccctgaatcatggcctgcagggaagcagaggtgaagaagtactgctggcgaacgcgcagcttcttgccctcgtaggtggtgtcattagggtagagcacgcggcagatatcggaaacgcgctcgcgctcgatgatggcgtcggtaaagcgctgggagttgaaggcatcgtaatcgaattcttcccacggctccgccttccacaggcgcagagttcccacgttgtgagtgccatagccggtgatcggcatgtcataaggaatagcgcgggttttcatatcgtcaaagcacacaaccaactggttggatgcacgacgaatggtaaaaggatattcctcttcgcgccatgggtctggcttttctacctggaagccctcgttaaaggactgacggaaaagaccgaagcggtagagcagaccataaccagtaacggggtagtcctgggtaacagcagaatccaggaagcaagcggcgaggcggcccaagccaccattgcccagtgctgcgtcattttcgatttccaggatgtcggtgatctcatggcccagctcacgggtagcagctgcagcctcatcaaccagacctaagttggtcaggttgttcagcagtgcacggcccatgaggaattcagcggagaaataatgttgctggcgagcagcaccataagcttcgcgggtgcgctcccaatcatcggcaatgcgctcctggactgcacgggaaagaccagtccagaacttgcgatcagtagcgaggtcggcgggggtgccagcagcggcacgaacatggctgccgacgaggtcggcggggagtggctgattttcagtcatagcagatgagtttaaaggaaaatgccggaaaatgaagcccaatcgggcataaccgggactattaaattcaataattgcttccgattgctaaaaacactgcgcttttcgacgaaaaactcttgcctgcggcggtgggtttgcgtcgaaaagcaaaaaacggccaacccccggaaggattggccatatccggcatgcttagccgaaaagcttggaaaggaagcccttggaaggctctgccttgtggccctggcaacgctgggagctcggaacatttttcataacctgatcaacgtgctggccgcagcctgcccaggtggtctttccgcacttcttacaagtaactgcgcgacacataatgtggcctctcttaaaaggggtgattgtttagttgatacagcgccggatctaaaactagacggcagtctgcaagtttttaggattggcagctgatttttcccacgcggcgtagctgccctcgagctcgataacggtgaatccggcgcgtcgcaaagcattggctaccacggtatttcgcgctcctgattggcagaaggttaccaaagtgccacccgcaggcagctcattgaggcgccacatggccgaacctccagaaagctgctgcgcgccgggaatgctgccagcggcaaattcggactttgcacggatatcaatcagtgcgtcatagttggtctcagctagctcagcgggggagatgagttctggcacaaaggtaggcaatccatcgatactgttggtgaaataacgcacagtgtcgatgccaacccgcagcaaagcgtcgcggaaatccgcagcggtattggcgtccggagccaaaacaataaggtcctgagcatccttttgaggatcaataacccacgccgcaaaattggacgccttggcgccgcgcggaatattcaatgccccaacaacggttccgagatggacttggttttgctcgcgggtatccacaaatactgcttcagaaccaagcttttcgacgacttcctcggcttctagcttcacaagcggggataatgtactaagtactgcaggtccctgcttgttctgctttttcatgcgagcaaagtaagcgtgggcatctggctggccgtcgagaagctcttccacaaagccggcttcatcatcactgcgcagatatggagcccaccacgcattagccttttcatatcccacggtggtgctagggatcgcgcccaatgccttgccacaagggctgccagcaccatgacctggataaacctgaatgtggtcggggagtgcaaggaactgctcttttaggctatggaagagttgctgtgctccggcgaagcgggtgtccacgccgccagctgcctcatcaagtaaatctggacgtcccacgtcacctacgaagacgaagtcaccgctgagcataaaaccgggatcctttgagaccgcaccatcagtaatcaaaaatgacaggtgctctggagtgtgtccgggagtgtgcttggctgtgatggtgatatttcccagcttgatggtggaattgtgcatcaaggtggtgcctgtaaagccatattgccaatcagctccgccttcgccagagaggaaaatctcggcgccggtggcagctgcaagttcgcgagtaccggagagataatcggcatgaatatgggtttcggttacggcgctaatgaccatgttgttttttgctgcaaggtccagataggtctggatatctcggcgagcatcaacaacaatcgctttgccttcgcgttggcagccaatgaaatagctggcttgggcgaggccttcttcgtagatgcgttcaaaaagcatgtgacaccttagatcaaagttgaggggatacccgtgggggtatatgtagagcctaaaacatcgagctttaatctgtcaagataccctggggggtatattttgaagttttaaaaaaggtccgggaaattctgaaatcccatatagatcgaaatgaagatcaagaagccagcaaaacctagttgcagtgatgatgctttgacctttttggctagttttacgccactaaaagcgcccaatacggtggtgatgataattggcgagatcactgaccagtcaatacttgccaaatcggaatatctaaatcccatggcaatagcgctgttaacggcgatcaccactagggaagtggcgctagcctgccgcatggaaaaaccgagcgcaaaaatcaaggctggcacaatggcaaaaccgccacccacaccaaaaaatcccgtcaaaaatcccacgccggtggcactaagagcaatggcaaggatgcttggccttctggttatgtattctcgggtgcttcttaatttagaaatcatggtcaacgccaccacgagcgtgaggatggcaaagccgctcaggagtagggaatcggggatattgctagcaaggtgactgcccacaaatgagccgaccaaccctaaaaggccaaagcttagaccctctttaaggcggacgtgcccggcagcgtattggctgatcagtccaatgagggcgccaagtccgatgatgattaatgaagctgcagtagcttgcgtggcgctaaaagaaaatccataaataagcagcggaatggcaaggatggcaccgccaccaccgagcatgccaagaagtaggcctattattaggccgccaagaagggctagaatcacctggctaacaataccctggggggtattatgaaaccaagctcacgttcttagtaaaaataaacgctggcgttagtgttgctacggcatgcacttactttcgcactctcattagtgcagctcatctgatattcctggccagtgacggggctggtgacattaatgtccatcggtaaaaagtcgcggatatcttcagtggtggcatttactccggttactaatttttgatgcaccgcgccgacaaactcgcagctggtatccgtccctgcgagccaggtagtggtgccgtatccatcgccataaatgcatactgtggctcgcgaaacttccaggtctacagaatcgcccagctgtgcatctgggggaactgggttcggggcggatgtagtgaccgttgtggtgagcatggtcgtggcggttgtggtgattgttattggtgactgaatgggatcggattcctggctgcatccacttaaagttgcaagcatagaaactgtgaggattaaggctctagactggaatttcaacatctattcctcctgcgatttgcatgggatatatattaaaaattctagccgaaagtttcctgcgtgaatacactttccccgcgccttcgcaaagctatgaatactgccgcgtgggcacaccgccaccacgtacgcaaaggcggtggaattccgtatgtcagccatctttattcagtgatgtacttgctggccagcgtcactaatgatgaagatgtgctcatcgccgggctgctccacgacaccctcgaagacgtacccgaggaatacaattctgcccaacttgaagctgattttggtccgcgggtgcgcgagttggtggaagagctcaccaaacagcccttaaaaagctggaaagcgcgtgccgacgcttacctcctgcacctcagcgcaggtgccagcttagaggctgtcttaatctccaccgcagataaactgcataatctcatgtccatcttggatgaccttgaaatacacggtgaagatttatggcaacgctttaacgctggcaaagagcagcaaatctggtggtatagcgaggtttatcagatatctctccagcgcttagggttcaatgagttgaataaacaactggggttgtgcgtcgaaaagctcttaaagcaaagcgcctaggcgctcggcggcgtcgataagctcggtgccccacatggcggcggggtggggcttgaggcgctcggccacgccggagatggacagtgccgcgatcatggatccgttggaatcaaaaacaggggaggagaggctagcaaggccgagctcacgctcgcccacggactccgctaagccgctggcgcgcacctggtcaagctcctcgcgggaaaagacgctggcagaggggatggggaggtaggcggcaaaaacgcgcgctgctgaccctgcatttaaaggcatgcgagtgcccacgggaaccacgttttttagcccggagctgggctcttggctggccacacacgtgcgggtggtgccggtgaggcgataaagctgaacggattcgccggtgcgctccataaggtcggccataattggtacggccgtatcgatgagggtgtcagcgccgcgtgcacccaatgaggcaagccgtgcgccgatggtccatctattatcgcgggagcgtgccaacatgccgtgtacctcaagcgctgaggcgaggcggtgggctgtagccctgggcagatcggtggcagctgcgagctctgccaacgatcgaggctgttctgcgatgacattgaggattaatacagtgcggtctaaaaccttaataccgctctcggtggagtcctcgataatttcttgctgtcccataccttgaatttagcatttcacccaatgagacgtggtgaagggattcactgtgtgtgggggtataaaaagattttgggcgggaggtgacatttatgcctcttaatagctatactgtcccatgaaacgatattttaatctcatatagtgagatttacagatttttaaaggacggtgagttccatgaccagccccgtggagaacagcacctcaactgagaagctgaccctggcagagaaggtgtggcgcgaccatgtcgtgtccaagggagaaaacggcgagcccgacctcctctacatcgacctgcagctgctgcatgaagtgacctcaccacaggcatttgacggcctgcgcatgaccggccgtaaactgcgccacccagaactgcacctggccaccgaagaccacaacgtgccaaccgaaggcatcaagactggctcactgctggaaatcaacgacaagatttcccgcctgcaggtatctactctgcgcgacaactgtgaagaattcggcgtgcgcctgcacccaatgggtgatgtccgacagggcatcgtgcacaccgtcggcccacagctcggcgcaacccagccaggcatgaccattgtgtgcggtgactcccacacctccacccacggtgcttttggctccatggcattcggcatcggtacctcagaggttgagcacgtcatggctactcaaaccctgccactgaagcctttcaagaccatggccattgaagttactggtgaactgcagccaggtgtttcctccaaggacctgattctggcgattatcgccaagatcggcaccggcggcggacagggctacgttctggaataccgcggcgaagcaatccgtaagatgtccatggatgcacgcatgaccatgtgcaacatgtccatcgaagctggcgcacgtgccggcatgatcgccccagaccaaaccaccttcgactacgttgaaggccgcgaaatggcaccaaagggcgccgactgggacgaagcagttgcttactggaagaccctgccaaccgacgaaggcgcaacctttgacaaggtcgtagaaatcgatggctccgcactgaccccattcatcacctggggcaccaacccaggccagggcctgccactgggcgaatccgtaccaagcccagaagacttcaccaacgacaacgacaaggcagcagccgaaaaggcactgcagtacatggacctggtaccaggaaccccactgcgcgacatcaagatcgacaccgtcttcctgggatcctgcaccaacgcccgcatcgaagacctgcagatcgccgctgacatcctcaagggccacaaaatcgccgacggcatgcgcatgatggtcgtgccttcctccacctggatcaagcaagaggcagaagcgctcggactggacaaaatcttcaccgacgctggcgctgaatggcgtaccgcaggctgctccatgtgcctgggcatgaacccagaccaactgaagccaggcgagcgctccgcatccacctccaaccgaaacttcgaaggacgccaaggaccaggaggccgcacccacctggtatccccagcagtcgcagccgccaccgcaatccgcggcaccctgtcctcacctgcagatatctaaggaaggctagaaaacaatggaaaaatttaccacctacaccggcgttggcgttccactgcagcgatccaacgtggacaccgaccagatcatcccagccgtctacctcaagcgcgtcacccggaccggcttcgaagacggactgttttccaactggcgccaaaacgaccccaactttgtcctcaacaccgacacctacaagaacggctccgttctcgtagcaggccctgactttggcaccggctcctcccgcgagcacgccgtctgggcactcatggactacggcttccgcgctgtcttctcctcacgattcgccgacatcttccgcggcaactccggaaaagcgggcatgctcaccggcatcatggaacagtccgacatcgaacttctgtggaagctcatggaacaaaccccaggcctcgaactgaccgtgaacctggaaaagcagatcgtcaccgcaggcgacgtagtgatcagcttcgaagttgacccctacatccgctggcgtttgatggaaggcctcgacgacgctggcctgaccctgcgcaagctcgatgaaattgaagactacgaggctaagcgccctgcgtttaagccacgcactaacgcttaagtttcagtctgatagcgaaagcaccccgtgatcttccgtcgcggggtgcttttgtgcgtcttggtgggcgagtggagtgggcatgtctggaatagaccaagaggccctggattcccttaaggtcttggtctttttcgtacgttttgaggcctgggaagtgcatatccagaccaagggaccccggtaagccaagacccttggtttaatatgacgctccgccccgagcaagccgaaaccattacctagaacgcatgaaaagtgcccctccagaatgggttctaagcccctaacaggctcaaacccaagcccatacccactcgccaaactggaggccttaaacgcgctcctatttaaccggcagggaactcgccaggtaatcagcgccggtgaacacaccgtcgtgaaagctcaacacccacacgctgccctttttcgccttgatcttctcatcgatagggagggtgccgttctcggagaaccatttgatcatttccggaatgatgtcgccctgcccaacgatcatcggcacgccaccttgcgcgaccacgtcggtgaagcgcttcttgcaggcctcgggatcggtttcccaggcgtcgtcgccgaacagtcggttgacggacacgtcgaggccgagctcatcggcaagggggagcgcggtggcttggcagcgatcgggcaccgccgagtaaattgcggtgggtttgaagggcaacaacatgggtacgagcatttctgcttgtcgacgcccctttttgtccaatgggcgcttattgtcgtcgccaccccaggtttggcgaccatgtgcatgagcatggcgaacatacagcacccgagtggtggaaggagtgcggaaacgctttgctgccttggccagaacttcggtatctacttggtagctgagcaactcgcatgcttcatcaacagacagccaacggatttcatcaacttcatcgttggggacaaactctccaccaagaacctgggcagtccagtagtagaccactttggttcggtcgagcacagggtaagtaaccttgccgatcagcttgcccagacggatgtcgtagccagtttcttcaaggatttcacgggccgcggttgtcggaatagactcgccgggatcgactttgcccttggccagggaccagtcatcatagtgcgggcggtggatgacagcgacctcgatgctgtccgggttggtgatgtcgccgcgccacagtactgcacctgctgcaagagttgggcgggtgaattcctcagtgggacgcgccgggatctgttgcaggcgaccgttgatcagcatggctgaatcttggtctttgtccacctcatgaggcttattgttcttatttgccattgggtgcgattcaccttccgcgttgtggtgcacacagttcttggtagaaaccagattaaaaacgcgcacataagtgaatgaaaaactacttccatctattgttcaccagcgacccgctcattgcacattctggactcggcgtgtggcgacatttttggatgattcctggcaaattctgggcagcagcggcaggtttccaggaggtttccatgcgggtggcttgggacatgggctaacctgagacggttaaatatcgttttcgaaaggtgggtttcgcgtggtttctgtaagcgtgatgggtgcaggttcctggggaaccacgttggccaaggtcttctctgatgctggcaacgctgtgacgttgtgggcgaggcgggaagagttggcaagcaccatccgtgacagccatgaaaaccgtgattaccttccggggattacgttgccggagtcgctgcaggtcacatcatcggcaacggaggctttagagggcgcagccattgtggtgttggcgattccttcgcaggcgttgcgtggcaatttggcggagtggaaagagacgatcccgcaggatgcgaccttggtgtccttggctaaaggtattgaaaagggcacgcacctgcggatgagtgaagtgatcgcggaggtgacggaagcggatccttcacgcatcgcggtgttgtcggggccaaaccttgctcgtgagatcgcggaggggcagcctgcagctacggtgattgcttgccctgatgaaaaccgagcgaaacttgtgcaggctgcagtggctgcgccgtatttccgcccgtacaccaacactgatgtggtgggcactgaaatcggtggtgcgtgtaagaacgtcatcgcgctggcctgtggtatttcccatggttacggcctgggtgagaacaccaatgcatcgttgattactcgtggccttgcagagatcgcacgcctcggtgccacattgggtgcggatgcgaagactttttctggccttgcgggaatgggcgacttggtggctacgtgttcatcaccgctgtcgcgtaaccgcagcttcggtgagcgtttgggtcagggtgaatccctagagaaggctcgcgaggcaaccaatggtcaggttgcggagggtgttatttcctcgcagtcgatttttgatcttgccaccaagcttggtgtggagatgccgatcacccaggctgtctacggtgtgtgccaccgagatatgaaagtaactgacatgattgtggctctcatgggcaggtctaagaaggctgagtagtcttaggttgtaagcttcaatgctgtgagcaactctaattctggaaaagtccgcgtcgcagtcgtttatggtggtcgcagttctgagcactccgtctcctgcgtctccgctggtgctatcatggcccatctcgatcctgagaagtacgatgtgattcccgtcggcattactgtcgacggcgcgtgggttgttggtgaaaccgatccacagaagctaactctcatcgatcgcaccatgcctgaggtggagcatcatgaagaggttcgcccaagcctggatcccgcacaccgtggagagttccacttttccgatggcagcttgtatgccaccgctgatgtgattttccctgtgctgcatggtcgttttggtgaagacggcactgtgcagggtctgtttgcactgtctgatattccggtcgttggcccaggtgtgctggcctctgctgcgggaatggacaaggaatacactaagaagctcatggcagcggaagggctgcccgttggccgtgaggtgattctacgtgatcgtaccgagctgaccgaggcagaaaagaacctgctgggcctgcctgtatttgtgaagcctgcgcgtggtggctcatcgattggtatctctcgtgttactgcgtgggaggattttaataaggctgtggggcttgctcgtgcccatgatgagaaggtcattgtggaatcagagatcgttggctctgaggtggagtgtggcgtgctgcagtatccagacggtcgtatcgtggcgtctgttcctgcgttgctgtctggcaccgaatcaggcgctggtggattctatgactttgataccaagtacttggacaacgttgttactgcagagatcccagcaccgcttgatgagaagaccacggaactgatccagtctttggctgtggaatctttccaggctcttgcgtgtgaaggccttgctcgcgtggacttctttgttaccgccaatggtcctgtgctcaatgagatcaacaccatgccaggatttacccccatttccatgtacccacagatgttcactgcatcaggcgtggcttatgaggaattgttggatgtgttggtgcagcaggcattgcaccgcgacaactagcatcaaataaaaacagccccacctctcaaacaaggtggggcgattttttatgtcttattccgcaggaaccgtgtcttcaatgaaaccggagatagtaatcagggaagaggaagcagcctgaggcagagacacggcgatgtcgatctcgcgtccaagggcataccaggtagacgaggtggtaccggaggccaaaatggtgtcctcgaaccacgggatgtcatcgatctgctgcaacatggcaccggctgcgtagttctcagaaggctccacgccgcaacggatcacaatgggttctaatcccggcgtgtcccacgcgactgcgtcgtcggagtatccggcggcctgcatgcggtcctcctcgatgcgttcgtacgttgtgccgtcgtcgccgccgacttcgagttggcgggggagggcgtcgaaaagcgaagtgcatgtggtgccggctgagctcaagccggtaagtggggcgtcgaagggctggccgtcgcgcttttctagcttgtcgacggcgctgctgaagggggcgacggggttgtcggcgctgtcggtgctgatgtcatcggcggtgatggcgacgacggggaagcggttgacggagtaccaggtctccagggaggagccgggggtcatgtcggagacaggtagccaggtggtgccgtcgacgtcgacggtgttggcgagcgcggtgtactggaatggcatatcgacgccacaacgcagcgtcacacgctcgaggtctgaggtggaccaggcggcagcgcccggtggaacaggatccatgatttctgcacgggtgtgcccgaaggcctcgccggggagatcctcgagtaatgcggcgcactcagcagattctgcgtctggggcgggaagcccactcatggctatctgttgctggccggcggggccaaggaggactcgggcgccgaacagcaccgccaaaaccaacacaatagataacactagggcaataatcatgggggttttgttaattcccccgttggctgggcgaccagcactgttcacggcactcatgtgtcctgagcctacctgtggggcgatagactagaaaaatactgacacttgaaccaaggagttgactttggcgcactcactttcattcccggattcgcttcgcgacgggccaaccgttggagacctcggggaatttgaagtgattcgggtaatcacggagcaagctggatcatctctcaacggcgatgacgcagctgtgcttcggcatgcatcacccaattccagggctgttgtcaccaccgacatgttggttgcgggtaggcatttccaattggattggtccaccccggaacaaatagggcagaaggcgattgtgcagaactttgctgatattgaggcgatgggtgcacgtccagtagccgcattgttggcgatttccgcccccacacacacccccgtggagtttgtccgaggcttagcccgtggcatgaatcaacgcttggaggagtactccgcggaacttgttggcggagacatcaccagcggggactccttggttattgctgtaactgcaattggtcaactgggtggatccttgccagagctgacgttgggacgtgcccgaccaggacagaccctggtggcccacggaaagatcggttactccgcagcaggccttgctctactgcagcactttggtccagacaacgttccagagcaccttcgccccttggtggatgcacactgcgcaccagttctcaccccaggccgaggcatggtggcacgcgctgctggagcgaccgccatgactgataactcggacggactgattgtggatcttaaccaaatggccatgaagtctggtgtgcgcatcgatgtggattcctctagcatcagccccgatgaactccttagcgaagccgcttccgtactcggaacagacgcctggcgatggatcttaagcggcggggaagaccacaccctgctctctacgacgtttggcgatgccccctctggattccgcaccatcggccaagtcaccaaaacacgccacgaagacctcgtcaccgtagataagaaaacccccgcattttccgatggatggagaagcttctaatgaccaacaccctatggaattcagtagacgaactccccatccacgactcctggaaaccagtactcaaaccagtcgaagacgccatccgaaaactcggtgtattcctcgcggaagaagaattccttccaccagtagatgacgtattcagagcatttagctacccctttgacgcagtaaaagtactgatcatgggacaagacccatatcccaccccaggacatgccatgggactgagcttttccacccaaccagacgtacgaccactgccacggagcctgaacaatatcttcaaagagctggtgagtgatgtcggctctttaggcgattcggcgtcagagcagggggccttggacttaggtattaacgcgccgggctctgtcgctggcacacaagttgccttgcccgcggacggcgacctccgtgcatggagcaaccaaggcgtcgcattgttcaaccgcgtactcaccgtccacccaggccaggccggaagccacaagggtaaaggctgggaagcggtaaccgaacaggcgattaaagccttggcggagcgggatcaacccttggtggcaatcctgtggggtaaacaagcccaagaggtacagaaattccttggagatacgccgtgtatctgctcagtgcacccatcaccgctgtcggcgtcgagaggcttttttggctctaagccttttagtcgtgcgaacgaaatcttaagcagcctcggtgccaccgagatcgattggtcgctgtaaggtatctgattatgtccagttccgaaagctcgcgttccgaaggctcgcagccagcaccgtctgtacagcctgaacgccgtgctgattcaacgggggctcctgcggcagcttccaaggaagcttcccaacaaatggacgctgccggagttcttgagtgggccaggaccgctgtcgagcagctttctgaacgtcgtgcagagatcaatgcactgaatgtctttcctgttccagatgcagacactggatcaaacatgacctacaccatgacagctgcgttggatgaagcgctgaaactgggggagttgggtgatgtcgcaaggattactgaggctttggctgttggttctgtgcgtggagcccgaggaaattctggagtagtccttagtcaggtccttcgcgctattgctcaggcagctgctgacggggttattgatggccacacaatccaagaagcgctatccattgctcgctccctagttgatcgcgcaattacagatcctgtggagggcactgttgtcactgtgttgcgttctgcagctattgaagtagaacacctcgtggaggcaggacacgccgcgttgcccgatgtcgtcaacgcagcagtgaaagcagcacgcaccgcgcttgccaggacgccatcccaactagctgttctccgagaagccggagttgttgatgccgggggacagggcctagttattctcctggagtccctggccgaacaaatcaacggaaacccacctcaccatccatcgcaccacagtgaaccagccgaagaaccctccttccacggcaaaaccggcgacctagaagtgatgttttacattgcatgcgactccgcgcaaacactcgatgctctccacaacgaacttgaaacactaggcgacagcctgctcatcgcccgagaaaccaatacccgcggcaccgttcacatccattcgcgccgggcaggcgaggtcatccaaaaagcatttgccgcaggagacgtcagcgaactccgccttgaaatcctccccgatacttccggcagcttcacggaagaaccacgccgggtcctcatggctgtcgcacctgacggcctggtggcggagctgtaccgcagcgctggagtgaaggtggtggcccgcaacatcgcgcaatccaagtctgatgatgtggtggcaaagatcgtttccatcgcgcgcaagtctggtgccgatgaggtgatcttgctgcccaacggtcttttgaccaagcgtgagctggtttccattgagcgttccagccatgcttttgagcaaagtgtggttattttgcctactgccacgttggttgcaggtcttgcagcggtgtccgttcatgagccagcgcaacccctggcggtggattcctatgccatggcagaggccgccggttccatgcgcacggccacgatccgcgccgccaccagcgccgcgctcacccaggccggcgcatgctccaagggtgatctattaagcttcatcggcccggagatagctctggtctccgaggagctcaacgacgcgctatcgcgcaccgctttaaggcttctcgacggctccagcgagcaaattacccttctcatagcgcaagaccgtcagtccgccttcgacgaagatgttttccgccgtggcctgggaactcacacggatgtggagatcacggtctatcctgctactggaatggagaatctggtagagatcggagtggagtagccacatgttgggttggcatgacgagcgtttgctcaaagacatccttccggcaaaggaagccacagcgattaaaaaggcgctgggctacaccactgcggaagagttgctccgccaccatgtgcgcaaatactcccaccacggctctggcgtgggaattggtgatgccactgagggcgatcttgttaccatcgtgggtcaggtcgcctttgccaagcagtcctatacccagtccggcaagatgctgtacaaggttacagtcttgactgagacggaacgcatcggcatttccttcttcggagccaagcacattccgcgtcttctcccagaaggcactcgtgcgctttttaccggcaaggtgaagttttttcgcaacgaacctcagctatctcatccagagttcattgtgatcccagatcctggatcaggccgccgactcaccgccactggcggtatgaaatctctggctgcctacggcgatgtggaagaagtggcacttcgtttggtggatcgcgaatacatcccgatctatgccggcaccgccaccatgactacctggcggatcatggctgcagtgcaacgggtactggaaaccatgccggtgatcaaagaaccactgagcgtggtgcccgaaggcatgcccagtttcgacgaggccatccgcggcattcacgatccaggccatgaatctcccagcacgtttatcaaccgtctgaaatacaacgaagcactatcgctggccacggtgatggcgatccggcgtgccgataccaagaaccgcaaagcaccacccatgccgcgcgcactcaaagggcatcagcacatgctcatcgatgcactcaactttcagctcacagtgggacagaagcaagtgatccgtgagatcagcgcggacattgaacaacgcgttcccatgtctcgtctgctccaaggtgaggttggttcgggtaaaaccatcgtgtcgttgatcgcgatgctgcaggcaattgattccggtaggcagtgcgccatgctcgccccgacggaagtgttggccacccagcatgcccgcagcctgagcaaaactctcgacgacgcaggccttgatatcaatgttgtgctcttgactggctcgatgcccacgggagccaagaaggaggctctgctggaaatcatctccggtgacgcagacattgtggtcggcacgcatgcgctgatccaggacaccgtggagttcttcgaccttggcctcgtggtggtggatgagcagcaccgtttcggcgtggagcaacgcgatcaactgcggaccaagggcagggaaggcctgaccccgcacctattggttatgactgcgaccccaattccgcgcaccatcgccatgacggtgttcggcgacttggcggtgtccacgttgcgtgaacttccaggcgggcgccggccgattcaaacctcggtgatacccgatcacaaacctggctgggttaaacgcggttgggaacgcatcggtgaggaagtcctcgccggacgccaagcctatgtggtgtgtccgcgcattgaaggcgaaggcggcgtgctggaaatccacgcctatctttccgaacaggtatatccaggattgaatgttggaatgctgcacggtcgcatggacacggatctcaaagattcggtcatgcaggaattcgcccaaggtgagatcgatattttggtcgccaccacggtcattgaggtcggtattgacgttgccaacgccaccgtcatgctcatccgcgaggcggaacgcttcggcgtttcccagatccaccagctgcgcggccgtgttggccgtgggcagcacgattccctctgcctgctgcacaccaccttcgacgaggactccccacaaggccaacgcctcgccgcaatttccaccacaaccgacggttttcaactctctgaacttgatttgcaggtacgccaagaaggcgacgtgttgggcacccgccagtccggcagcgacaccaaactccgtcacctctcgtttatcagcgaccaaaaaatcatcgagcgtgcgcttatcgacgccaccgagctggttgccgccagccgttccagggcgcttgagctggtcagcgacatcgcaatgatcaaccaggaatacctggaaaagagctgatattgatagggtttaagtcatgaagatctacgcaccttttgctggaatcgtccactattttgtcgatgaaggcgatcccgtggaaaccggcatgcaactgggaacggtagaaaccatcaaactcgaggcaccaatcatggcaccgggacctggcatcgtagctaaggtttcttttgatgatttctccgacgtcaccggcggcgatgaactcctcgaattggaggcaaagaactaatgggtcaaacccgcatcatttccggcgacgcacgcggccgcaagatcgaagtaccaccagcaggtacccgccccacctctgaccgcgcacgcgaaggtctcttctcctcactgcaggtccgtttcggatttgagggccagcgcgtcctcgacatttttgccggctccggcgcactcggattggaagctgcctccaggggtgccgatgaggtagttctggtcgagtcgaatcctaaggccgtagaggtaattcgacggaatgtggacgtcgtaaagcatcctcgcgtaaccgtcgcagagatgaaagcatccacctaccttgcgtccgcacccgataagtttttcacgatggtgctcgccgacccgccctatgagcttgccgacgacgccgtcaccgagatgctcaccgcattgacgcctaagcttctcgacggcgccgccgtggtcgtggaacgccacgtagactcgccagaaaccgcatggcccgcctggctggtacccaccacccagaaacttaaaaaacgaacctacggcatagcacgcatggacatggccgttttcgacgaatctctgcttcaggagtaaccaatgaaagctgtttgcccaggatcattcgaccccatcaccctcggccacctcgacatcgtgacccgcgccgccgcgcaatttagcgaagtcaccatcttggtcaccgccaaccccaacaaaaactcaggactgttcaccgtcgcagaacgcatggatctcatccgcgaatccaccgcacacctcgacaacgtaaaagtagacacctgggcctcactgctcgtggattacaccaccgaacatggcatcggcgccctagtcaaaggcctgcgaagctccctcgactacgaatacgagctccccatggcacagatgaacaggcgactcacgggcgtagacaccttcttcctcctcaccgacgagaaatacggctacgtcagctccacactgtgcaaagaagttgcccgcttcggtggcgatgtctccggcctcctacctgaggtagtggcaaaagccgtgacagaaaaatacagcaaccagcactagtttcttttgcatcaagcgtctagactatggaaccgacttatcacagacacgtgaaataaggaggtgacagcgatgggtgtggaccgacggatgtggaaaatgagtcctgaacgacttcaggaacatctgcaactgaaaaaccgcgcacgacaaatcccggacaagaagaagcaacaaaacaaaagggcctgccgagacaattctcggcgggcctcccgcaattctggggtatttccacgtggtcgcttgttgccttcaccctgttgggtggggcagctttccgcaaccgtcagaattaggccaaatccctaagtgactgagcgtcccttggtctgaaaatcgcgtttacaggctgaaatactgcagatcgagaccaaaacctcgtcggcagtaagctcccttggtctcgatgggacggttaatggattcaaaaacccgtccagtgtgagttcgagtctcaccaggggcgccagtatcagtgggatgccttcatttccgagttcttgggttatcttgaacgcaaaaacctgcgagccgataatgactcgcaggttttttaagacccgaaaaggttagagcagagaagacaggaagtctttggtgcgctgttcctttggattgtccagaacttgttcgggggttccggcttcaacgacaactccatcggccatgaacacgacctggtcggcgacttcgtgggcgaagcccatttcgtgggtgacaacaagcatggtcatgccgtcgtcggcgagctgtttcatcactcgcaggacttcaccgacgagttcagggtccaaagcgctggtgggttcgtcgaaaagcatgagctttggctccatggcgacggcgcgggcaattgcaacgcgctgctgctgaccacccgacagttggacggggtaggcgtccgccttgtgggcgaggccgacctgctcaagcagctccatggcacgtgcgcgggccttgctttcgggctgcttcttcacgtggatgggagcttcgatgatgttctcgatcaccgtgcggtgggggaagaggttgaagttctggaacaccatgccgatatcggagcgctgcttggcggcgtccttctcagagatttcgtacagcacgccatcgcgctcgcggtagccaatgagatcgccatcgacatacaagcgacccgcgttgaccttttccaggtggttaacgcagcgcagcatggtggatttaccggaaccagaaggaccgatcaagcaggtgacggtacctttaggaacctgcaagtcaatgcccttgagcacttccaagcgtccgtagtttttgcagacctgctgagcatcaatcatcagttgcgacatttgctagttctccttggaagtttcaggaacaacggtgacattgcccgggattgcgccttcagcatcagccaacgcagcgagctgacgtgcggtcagggtgcgggtgctgcccttttcgaagtgcttctccaggtagtactgaccaaccataagaatagaggtgatgaccaagtaccagctcgcagcaaccagaagcattggaactggctcgaagagggagtacgcaatatccatgctgcggccgtacagctcgagagaataaggaatcgcaacaaccagagaggtggtcttgagcatggagatcagttcattgccggttggcggaatgatgatgcgcatggcctgcggcaagatggtgcgacgcatggtcattgaccagttcatacccaaagctttcgacgcctccatctggccctcaggcaccgcttggatgcccgagcgcacgatttccgccatgtacgcagcctcgttgagacccagaccgatcaccgcgagcaggaacatattagacagcaagctttgcagatcgatctctgcgaaaccgaggttgatcgactggtacaaggaacccagcaggccccagaacaccaactgcacataaattggggtgccgcggaaaatccacaggtacagccacgctacgccctgcatgacagggttgccggacatacgcatgacggccaagattgcgccgagaaccacacccaagatcatggacagcaaggtcagcgcaatggtgtgaagtgccgcggtggcaatgcgggtgtcaaaaagatacgagcggtaggtatcccaaccgtaggcctcattgttgagcgcgctgatgataaaccatgcgagcagtgccacgatgatagcggctgcgacccaccggccagggtggcgtagtggcttggcttcaatcggtttcggttgggccgttgaagctccaggcccttgattaagatctgacatctgtgaagtaatcctttaattgtttttagttgctggaaggctctagttgagtggctgttcgttgatcagggcctcatcaagaaggccttcttcaatgccccattgcgccatgatgcgctggtaatcgccggtgtcaatcaagtgttggaacgccgcagctgctgctggggtgaggtcagattccaacgggaatgcgaaaccaaatggcgcagccaagtacatatcgcccacaacttcgatgcggccttcggagcgctctgcagcccaagctgaaacaggggagtccgcagcaagtgcgtctgcgcgtcccaggatcaatgcggtagctgcagtatctgcggtttcataagacaaaatggtgatcggctctttgccttcggcttcacattgagctgagcgaggacggacatcgtcggtctctgccacggttgtgcgctgtacagcaacggtgagaccacaggcgttttccggatcgattggggtttcacgatcagttgcctgcgcccactgcacacctgcgaagaggaaatcgatgaaatcaaagttctcgcggcgttcctcgttgtcagtgaagccagaggctccgatatcaagggtgccagcttgaaccgatggaaggatgagggagaaatcctgctcctgagggctgaactccaagcccatcacccccgccattgcacgcacgaggtccatttccacaccgataatctgaccatcggaatctttaaactcaaacggtgggaaaggtgggttggcaccggcggtgagcacaccgcgctgagccagagcttcgggaaccatcgcctgaatctccggtacaggatctggaacgatctgctcccagccatctgggttgccctgctcctcattggtgacacaagaagccaaggtgaatgaggttgccacgatgccgacggtcgccgctacagcgcgcttggggattttggggaaacgcaaagtgctatgcagtagccgtttcagaggcggtgtctgcgaaattcgcaatcgggtgaaactctcaatcatgggcaaaatactacctgccatggtgcaataaccttaagtgaggctggattttgcgttggcaggcgctcgggttttgttttatccggcatgggctcgggagggactttaaaataaacagctatgtcgagccaacaaacgatcttcatcattttgctctttgccgcagtgattctcatttccatagtaatgattacagctgccttcaaaacccggaaaaagcgctttgccgcgcgggctgaaggaatggccaaccctacaattcctgcgccaactgtgccgtggcagcgcttcgccggagcacttgcagccttgtacgctaggcctgaatggcacaagacccgcggagcgaaacgagtgtactcagctgaacagacttattttgggtttgtctcagcaatgccactggggatggtgcaaaacatgctgcaaacagactggggtgtgaaaaagtctgagcatgcagttgatcagctttctaaaggagtggaagtgatcgttggggtagccgcaggcaactggcgtaaaaacggagtatcacccgcacaagtggaagaggcaggccagcggttagcagctgaaggattggctcatccacactttgttgtattccaaaagcagcttcaacaggcagatccaaatgcagaatatgatctcgatgtgctcgcatttgatatcgcacgcgtagccaacctccttcgctgggctgcttatacagatctgttgctccctgcagaagcccgttggttccaagaccagctgggaattgcggctgctgtgtcctttgggagctgggaagaatacggagagcgatacgtccgtggactacagaagaacttcaagggcggaaacaagccatatatcgaaggagaacgctggctcaacactgaggctgaaagtccatggaagacccaaaagtggattagcgcctaactgctcatgagctaagcggcaaaaagccccgagtctgccttcaaacggcagattcggggcgatttctttgtggagttcttatttagcgcgggtgctcttctgccacggtctcagaatcaatgttcttggaagacacacgctcagcaaacatcaaagcagcgacaatcgcgccaccaagaatgatgatgctgaaaatcatcacggcgttatcgccaggagcaagtagattagcgtcaccgtcctgccaaggccacagcgcacgaagtgaacccagcatgagaccagccatgatggtcagcgtgatggtgcggtggtgctcgagaacataagacaaaaccttcacaaacaagatcacaccggtgagcgcgccaagcaagaacacgccgatgaccgacaagtcacggttggacagagattccatgattggcgcgtacataccgaccgccagcaagaagaatgatcctgaaacaccaggaagaacaagagcacacacagcgatcgcagcacagatgaagacaaagatcagtgaaggatcggtgcgaggcgcactagtgaaggatgttccaaagaatcccagcatggcgcagattataaatagcgggatgacgattgcgaggcgcttcttggcatcccgcatatccatcattcccaacggaacaaggatagacacggcaaccattccaaggaacagaccgcgagtgatctctgggtagtcctcaacaactgtatgcaaaatcgatgacatcgagaagaccatcacgaccatgccaacgccgatagcgccgaggaaccaccagtcgattttcgccgcagcttccttaaccttcgagcggtccttgatcaacaccttgatcagatcaatgaggagatcaccgttgtgcagtgcgcgctcataaattccaagaaccaaagcgacagttccgccggaaattcctggcaccaactccgccattccaatcaaaccaccgctaatgatgttgaaaatcaccgcaagtggagtctttttcgtcttgatgggatagacgtgctgcacgtctagggcatcagggttggtggcgctcataggtaatccaattatctttctttggcgtctggcaaaacgcctcccactatacgtgttacgaaactaagtcggtagctggcaaagggtgatctgtgctgaaaactgggcgtagggtgcagaaagttgggtctctcaactcagacgcatttgtggccaatttgaaggctctaatgcttcgcacgggcaaatagtcggggagaggttttacaggccgttagattggattctgtggcctcatgatttttcggcatcgaagcatcaactcgggcagaccagactggttataagtggtcgaaaccagccaggggtgacaagagaaggccgaaatccaaagttttgtcacgtgtgtccggtttggggagattgcactagtcgatcttgaaactacccccaagtttctgggcgatttttgtcgagttaccccaaaaatgaagaaatcccactgctttaaccgcagtgggatttgatttctagaacatcttggccgaaatcacttctccaagtcggagtttccgctggtagtggtgcccctggtgagactcgaactcacactggacgggagtgagaccagatcatttctgtcatgtaattgagtgtttattgctgttgttgcagctcgatgttaactaaaaatgcaactattgcgtctattcttcttctttagcttctttatttggagactttttggagacttttcgtgcctctttgagcgcttggttgacgacatcaccaatcggaacgtctttgtcagttttagcgatgtagacccgttctgtgagtcgtgagtcagcatggccgagtacgtctgatgcggccttggaatcaaggttctcagagacaattgatgcaagggttttcctgatgctgtgcacggtcacccaatcatatgcagtaccctttcggtgttttcgcaacaatttgttgaaattggactcataaatatatgtgcctctagcggaagggaacaccatttcgagatgttcggcgtagagtgcatgtcttttgcgtaagacgtctgaggcaatttctggcaactgaatgacacgcctactgctggtcgtttttgttttatcttgtctgtggttacctttttctttgttgtagacaatggtgcctcggataaagattcttggatgctcctcgtcaagcaccacgtctacccatcgcaggctcagtgcttcccatgctcgcaacactgttccaaggcagacatcgacaacgtcgatgagagtcaattgttttgaggccgcaataacagcgtgaaagggttgaatgtcagcaacctgcagtgcttggggctcgttggtttgtgcttttacaggtcgcacttcagccatagggttaacatgtacaagcccgtagggggtttccccaccgagttcagatttgtcgtgagaaaagggcattatgaccgttacaggaatgaaggctggggatatttaaaaaactattgcaaacacaacttcgccaaccacgctatggctgaggccgtagtagataaagcggtgattgattatggctcatcgccaggaaccagctattacaagttcgagaaaacggtgtactttctagattgcagaacttatacattcaataagaactcaggatgtaaagaaatgcacgctccgcaatgggtgactattatttacaatcctcatactttcactggagcaaattcgaacagacccaagggggtaatttcagcatggtgtaactcaaccccacctggtggaatcgaacacgagccggaaatttcccaatgtcctgatcatgtgaatctttataataagcttcgcatatgacagaaccccatcaactgtgcatctacactaaaggccataaaacttccggatttcgctttatcgggccatcgctaagtctagattttctactcatcaacatcatgggaaagtggaatgcattttctagagtgacaaaaagggacggtagttcattacctttcccaggtaatgtatttactaatcagcgcatagtcggagctgttcggcagtgtctttttcaagcgatcgttgctgaaaaatggtcacttttctcgtccaatataagatccttagtagctgatctaccggatgtgctcactgtatctgagttacaggaatggttagagttctttgtgcagcacaccggaattggtgtcaaggttgggcgtgcgctgattgttgatcctgatcaggagtggacgcagctagctggacgttgtgagcttgtgggatattgtgcactgagtcctggttggcccagtcctattagctcggttttcgaaaagacagatcttgaattgtgggagtcagcattagcgacgagttggatgatgctggggccttttatagctgaacgttatacctatcaaatgccggttgaggagttttattggcgtcatgatgcggagttgcggtggtgggagagctttgtcaacggctgttttgacgatttaacaagtttgcagaagcttttgagtctgttactggctaaacactatttatcgagagattacctaatggtgcgcgttttcacaattgattagtgcgccgggtcaaagataatagtcgcaagcgccgtcgtttaaaagtattgtcgttcagtagccggatataccctccgactgctgacggttaaacaagagctgaggtgagttccccaacgagagtggagagtgaagcttgaaaagaggcaggagaggtaggcttcctgcggctgaagttgataagttgagctcatgggatttagcgcgttggagctgtggtcgaccgagctaggcataactgtttcggtcacgcctgagccacagaacagtgattatgaatcaggattagcacaggttgaaggccatgagtggcatgtccggactgcacggaacacgccgtcgaagccgggtgcctttgttgccttttggcagcgaggcgtaggaggacagacccagccgtttagtgacgacgggatgaatgccggtcttcttgtctttgtgaggaacgatgttcggcgcggagtgtttaggttttccgctggtcatcttgcagaattggggattaccgcagcagacggacagccgggcaaacgtggatttcgcgtttacccctcctggtgcgaagggctcaattcgcaggcgagggccacgcagcgagcacaatctagcgcattcgaggagtattgagatcacgtcgtgctcacccccagtggagggtggcgacgatgttgtgactctggaggtttttctgcaagaactgctgacatcgttagtaaacttaggtctgttctgccggtgggctatctgaggtttatatagcaggaaacaacgcgctgagcacagcccagatttcattggcgatcacgtctcactgcatgcacatgagcgtttagtgcaggaactccaaaacttttggtcacacactctagcgtttttgggcacggtattgttgtgcggtatgaacaacgcgagttaatacacggaaagctcctgagaatagttctttctcagggcttgaagcttgagggcttgaagcttgagggcttctagaaagcaggtatgaggaaagtactttcccacatgaatcagaagaaaggcatggactgggatgaacaaggctgatgaaatattcctttgcgaaggcgatatttttgctcccttgattgcgggtttaagtagcgttaacagcgcgatccgctctgccgcagttcatcatgcgtttagatctatggatcgcgctgcagcaacgggtacaacttatggagcgagtatcgttcagtcactgtgtgacattgttgttacgcatatgtatgtcgaatcagattctcaagtttcaattgattctggggttgtaagtgcattgacgattgacgggaaagaagtctctctcgatctccccaataaggaacttgaatcattagggttagatgaatactcaacctcgcctagcggtgcttccattgcagttacgaatgaaggagggggagctttccgatctctaattcatattcctaacctggaatcaaatggtgagttcgaattttcattttctaatgatatgactcttagttccttgcctgatggcggagtcacagttcgagataataagggggatatcttaggcacccttgatgcaccttgggctatagatgcgacaggggcctcggttaaaacatggtatgaaattcgtcaaagcacgatagttcaacatgtcgcaccaacttcttcaacgcaatttcccgtcgtagcagatcccttctggatcccattcttaggtatcatgggtggccatctcacgcgtcatgcgttaacccagatggctaagcgaaagatcactaaagagctagttgagcacgttataaaaacaggcagaggaagcaagggcaacgggaatactacagtatttaacggcaacgggattcgagttattgtcgataatgtgagcggaaatgtgattactgttacgaaaggctaattatgaattttgagtatgacccagaagctgatgcagcctatctaaccctaacgcagtcgggtgtccttccagaacagcagatatcagcaataactacagaaggaatggaaggagaaatagagatagacgttgatgaaaatggcaaagttattggtattgagttcgtgaatgcttctttgattcttccttcagatttcctcaaaaaatcaaaccggatatcataatcccatctaaagggttgccaccagacagaagatctgtcccctgctcaggttactgtaaaaaatagcgtggaatcacgacacggccatagtagtggacgaagctggtatgggttctggcccttatttatggagttacaacacccataaataagggccagaacccattactgcctgtataaagagcactacaaagccacagactaacccggcttacaggcccatcccatgatcatggctacggctcggattcatcctgaattgctgatccgcactccgaccagcacccaatgacttagaatctgacgacgcattcacattaaacgtcctcggctgtagctcttccgtaaacgccaccgttgtccgtgcacagacgtgcttcccgttcttcacgcggcgtaaggaaccaacttcctgatagtggacacaagggtctaattaggtagcagatttcaggatagcaggaccgcgctcctcaaaacactgctggtgcgagatatttacaccaggaatgtcggcgtaccgtgttgtaacgggtacaccagcgcaaggcgtccgggcagcggatcgaccggggaaccaaaagcagcacgtttaaagccctgcgctggtttaaaccagtgcggggcttgatgtgttgaatgcttaaagctagttggtaggttcccaaacattgtttttcaggttgaagacaaaatcgagcgtagagtccgtgggtcgaaatgatatgtcgtagtcagacagcacagggcaaagatcaacaatgtgggtccttttgaaactaatccactcggtattactgctagtggatttcagaacaagtatgctttgcgtctcatcaaatccaaatctaggtacaggcgtgtcttctaactgaagttctgcctcgacagtatcttttggcgcatatgggcagactatagcgaattcaacccattcatcgccataaatacttctaagattgagagactgatgggacgactgatctgctgagcttagatgactctccagggcattttctgtgctgcaactagcgagggtcagagctgttaaggggatgatgactgctagtcgcttttttagcatcagagggcaccttgcttattttagagtttttagtctaccgagatttgtccacagcgcgcatatcgcgagcgcgctagtttcatccttactattaatgaatccggctccgatctgtcggccttgtgcattattgaataggtccattgcattttcatcggccggaccgtccccgattgtctcgtggtttgttgcaattctttcagctccattgctcccgattcgtatcgtcatcagagcgttccatgagcaatgccgaaatgcatcgcctttgccgttgcgaagggaatcgcctgggtatcgtgcgacagcctcattatttgctttggttgctgcttggtttgcaatcccgcatgatacaacatcaactagattgatgcatgaaagcatttcgaggcctgatatgtaaattttgtaggggtcggactgtgccgcgagacgggtttcttggcgttgttggagtgaactcggatcccgtttaagcgctgctattattgaacgctgttcgatgtcggtgagggtatcgaagtactcgtaggggtcatgagaatcgtacatagttgtgatttcatcttgagcaccaaggatctgttcagctgaaatgtcgcttgtgtttacgtgaatctcggcgttgaggtcgattgcagattcaggtaaaggggtgatctgttcgaggctttgtgcagtggaagtagggcttagtattgtggttaagccgatgcatagtgtgattgcagaagcgcctgcaatacgactgactctgtttaacaaaaagagctcctgatcatgtaggtgtcctgaaacgcgattagattgtttcagcacagacgctaacaccgatttcgttcggaatctattattaaattcatatttcaatatttatctaagggtttttccaatgtgcaacttccggaagcctgtggtgtagtgaaatagatcttctagttaatggcgcatgactaaagaactcaaaaatacgtatttcgctatggaaaaaaatgacgcttaaagtgcttattcgatgctgtttaaaagcaacataatagtgccttaaacaccgctagtcaggcttactaaaaggccagaaacgagcacgtaggggacactagagtttatggcgtatcgcaccttagcaaaagaatttccaagctcaccgcacgatagtgcgcaatctcgtgttgatgcgctttatgagcagaggctgcagcatgtcagcactattaatacaggcattgatgttggtggttatccagtattttgcgttgttgatgcagaagtgacctctcggtatacgcgcaagccccgcacgtcgagggcggggaggatgtcaagcaacgccattcgtgatcggtgtactggaacttatgcgcgattttctagtagggggctcagagaatccacctagctggatttcatggaaggaagtgaaaaaaccatttgtttctgcagtatgtccgcactcgcttagttgatgtcatccaatgtggagaagttcaaaagctgaagcgggggagcgcagttctacttcgagcccgacccccggagagtagacacaggggatttaatcaggaagcagatttcaggatagcaggaccacgctcctcaaacaccgcaggcgcaagatatttacaccagcaatctcggcgcaccgtgttatagcgggtacactagcggaaaacatcccggcggcagatcaactagttcgcaaaagtcttagaatcttggaggacttcccgcctgagtgcggcgttgaacgactccgctaacgcgttgtcagcactggtgccaattgatcccaatgactgcctcattccgaggctgtctatataatatttgtagggttatatttgttgtctatttcccttctaaaacagcacctgttcgaaagcgtcgacgcgactggggaaagcatcaacgcttacgtctcggtcatccatgatcaagagttcagcagcttcttcaaatttctctatgtcatttagaatgaccacagtgtaaacatcgcacagtatatggttttctggatatttaccgttatgctccatctgatattggtcggaaagtgactcccatccataagctttttcagcctgctgaaggtttttagaaactgaaattacatcaacaccgtccagagccaatagattctgaactcgttcgcgatatctgctgtaagcgttactttcattgccgttttctacaataaattgagttagaaaaacataagtctttcgcatgagttgattcgcctagtcctttaacttcggttaagaccttcaaacggaaagcggtcaataggtaccggaaggcaatggcgtttagtatgaccaaatgggacgaaggtattggcccttttttcagcctcaaccttagaataggcatgaccaactacgacccaaccgtcatagttgttcaagcttggaaccgaccaaattttgtggacattgcactttactgcaattcgatccatggcttgaggcgcgattatttcattcgcctgaatagtaggggtgattgcaagtgataatgctattgcaataccaatcgaagctagtttcctcatgtcacattccaatcggtgtggtgagtgtgtggagttggcaagttgcggaacgatcttgcctgatttctactgttgcatatattttcgcgaaatgagccttaacctataaaatcccctaattgttataggaatgatattgttttattttgttttggcattgtttcgtcttattaatccatgcttgcaattggttagattcgggtcgtggctaacctaagtgaggttgtgtagatttactgggttattcaataatgagtgtttggtggttgagtggcttatcccttaataattctccttgcagcctataagcgttaggctttacctacacacccggaacacccttacaccagcgcgagctacagaagattcacagattgggagcccttcgatgagattctatgtgaccaatagggacaccgatcctcccatgggatcgaggggaacctgggttaatctactccgggacaattgggatgactatgggttcaaaacttcttttcatgtaaaactatatcgggacaatggcgagacaatacagctcggaatggtgaagatcctgcgtgccggacaaattgagtttttactgacctaggggaccgactgaggaagtcgcacagtgccttttgtcatgcagggcgctgaagaataaatttgtttacaattttagtgtaggaaatgcgcgcgaacagcgtcgaaggtatgctcatttacgtatccttgccctcgtagccatcccccgagcgctatgcctgaggcaggggcacgtctggtttctgctcaagaatttttcgtagcattccatagttgcgtcagatggaagctggcgttgctgagttagtcagtcgaaggggaaaggttcaatcgtccagtttgatgtggagatattaccgtcatatggaatccagcgttcatcatcccacggtgcagctgaagggggttccgggctgtcccatctccactgctgccagtcaataggtagtcccgatcccaagcgtcgtgaacctgcagctagatgatgccctgagggagtgctataggaccaccagtaggaagtcgaatcggctgctccccgggtaaaattgctgcgacttaggttccgttgttctatgaattcgaaagcctttttctgccatgcgtccggttgtgaagtcggaaaaatcacttgggaatggatgaaactgtcgaggtccgcagccagaaagtagagttggtcaaggtgcctatcgtctcttaggcgtccttcttcgttagttccggttagtttcgagacttcgagctcatgctttctgcgatgtcgcttggctacttgtgctgcgcgttcctcaagatattcgacgagggcgccgagaaggacgagcgttttcgtcgaattggtctgcgtaccgaaagagaggtcacgtccgtgagccgcgccgtgtcttgagagcttgccgtaaaacccggtggcgttgatggcctctttgaacaggtcgcgaacaatcggcagattcgaagctatacctgcgagagtcgaatcgtccagatatgggtcattagacgaattagagaagaatgttgctccggttatatctcgggtaagcccatcgatttgggaaaagtcagaaggatagcggctgcgtaattaccattctcatgacacttcactgcctggtcgatgagatttcctcgttgaaattgaagtcgctgaaagctgtaatcaatacctcggccataacgccgaagtggaatggctacatggtgaagaaaggattcactggtattgttccactgttgtgtaacaagggcatcgatctccgcgctgtcagtaccacggcgagcaagctccacaatctgctcagtgccgcgccgatgccacagcccgtatgacgcccatccaagaggtgcaaggatttctactgcaggtccgatgaggttgtctcggtttagtgcaaagtatttcatttactcatcctcccagttttgaccaaagtgtgcacctactggtgccactggaagagcgccggagaggaagggctaagtggctatccgatgctactgtgtactatcacccacaaaatatcaaggatcttgttgcactggcataatgcgacggggtatggctgcacccaaggattaacgagatcgcccatggttagcaaccatgatagagccctctaatcttgatgataaacctcagggattgctcctgaggcaattggattaggaactgagaggggataaagaactcgaaaaagttgccgaaggttgatcctcagcgattcggtatcgagatcgaaatccctcgaacgctcgttgttcttcttctacagaagtactattttccgaactcataatttgatgtatccatgcagtgtggggcgaaatagcagaatgccacatttttttaccttcccccggtgagcagtcaaaattgatcgctccggctgtatgtactgcatgaatcgtattccctgcaaagactgctcctccggaatcaccgttacagcttctagaatcagttaaagaaacagtttccagtacatccaaataataggtactgaaacctacattgaatttatctaagtgcgctactgactcaactctcgcaattgaagaaaaatcgttgctaccgccgtacccaatgagcgtcagaacttttcctatagcgatcttttcttcggggagatcaaaagtttgagcagaaatacctctccccaccttgattaaagctaaatcatggtgctctgaaattgtgtaggtattttcaacacctgcgacttcaccatcggattgctccaggtatccaaggaagtctttctcggaggtaacgcagtgccgtgcggttatccaaaattttccctcgatgtgattagcagtacaagaacgaacaacctttttggtatcttcggcctcaggatcgaactgccacagcgcggcgattctattgtccactacaggatgagtgctagtggcttccagattaatatttgaaagattaaaaggaggatatgcctccgggttctgctgcaattcgcggtattcagaaatagtattcggccattttccaccactatcctgctctttcgttatctcttgcgcatgtaccggaatggtgaacggcatcagccctatcaacagagctccgacaaaagagaaaaagcgactacacatacaacgtgctcaattcgactacattatgggatgaaaaccgccatgacctctagaggaaaatgtcagaggtcatggcagctaaggaatggatctcgctaggggatttaaccgttttgaggcggggagagttcgtctttcgtcttttcacgctgagcctcaatttttctttgaagctgaacgaaaactggctgcatcaagatcgtaagtattactaatgcgatgagagagccggtaattcctatggaatcagactgtaaagctccagagaaaatcacaaccgagagcacaatgatcgttgtcactgcaagagctgtgtacgctttcacattaagagtctgcttgttgccccgcgctagtaactggaccccaaaaaagagaaccaccgctactgccagcatgattacaattcccattatttctccttagcagttggcgacagcgccagtgccatatccagcaagtccccctgctgcaagcacagcaaaccccgtgccacctgtggcaactcccaaagcggcgagagctagaccagttgccaccacacctgctaccccgcctgacaaagcgccgactccgcatcgccagtcctgtaaatctggcacctcatctggattcatggtcaacaaagcagtatgggaatcgactttctcgattgagaagcctggttgggcttgaagttcagctgtcaaattctccagaagagtgcccttattatctttcattaagatttcgccgttaacatcttcgacgacggcgttagaaagcttaataagtagttggttttctgccacgtaaagcaggtctgcggtagcttcactggtgtttgcttctgcgtctgcttctggagccgatgatgaagagaatgcaggtgtaatcgcttgaaagctagttggagattcagctgcagtagctacggatgtgagaatagatgctgaaacggtaatgccagcaattaaagcaataggacgataaaacccgaagaacttcataagtattcctttgagctagataagcggagattacacgagccggaacttctgtgaccggtgtgttactaacttcaggtgaaccggaagatagcctagtgattcttttatgtcgatcttcagtgtggtcgagaacaaataagaatgtttttatgctagcagtatgtacgtattcaggtattaagtggatatgcttaagctctggttcacttatggtgcgcccttttagataaaggttggaaagggtgctggtgtaattatcccagcaggcggagagaagatagacagtgagctcattgtgagttgagggtttcacagctattgctgcatgtgccaggatttagcacggtacagtgctaaaaatggacggactgtttaccccgttttcagatgcgtcattaaacaacacggtaaaaactgatggagattcagtacctggtcaagacttacctattacgaagatctctgaggatcgattcgagcgttctgcgtatgcagcccagctagcgaagatcacgtgcgatgtggcctctcagggagagtacacagttttcggtctcactggtcagtggtgttaattatggtgttcatgttctgcttctttgcgttgtcggaggtgctgaacttagccacggcgctctgaatcccggatctctcggatagcccagatagtgctgccggtgataagaactgcctgcagtagcatcgcaataaggaagcgggtagtagtatccgctgtttctggccaggatggtactgctacaagccagagcatggtctcggctagcacatctccgcccaaggttattgagataactgtccacagcacggttgcagcgatagctacccctgatccgaagcggattcgtagggcggtagagaccatagccagtaagattccggtcaacacccacaacaccagtcgggcagtttgagtgacatcaccaccggccagcagataggcaccacctgtacctagcgcaagtagtaagagaacaatcgcctgccaggtaagatatatgcctctgatacggtgattctcgatgacagtaataagctaagtgtcaagcccgtgtactgcttatattgtacggaactgattccgtccgtatagctcagacacgtgaacgagttagtaatttttttatgcttttttgtactgccgggtggttatctcgcagtggaatataaattcgattgcgagtttttttcaggctctcagaattgcccccatgtgggcggaaaaaaggtgaataaattcccttttttaccccagaattttcagccacaagaggggtgcggattggggtcaagaatcatatttcagtcacagctgcgggtgtaaaaaaatggctcatgtccggtgatggagctacgaaaccggggtagcggtggcgttctaaaatgtgatgcaaatcataataatacccccgtaacatgaagatgttacgggggtattattgcgcttaatgcccattatcgctgattatcatgcgattaatatttagacactttttggacacctaagccctatttgatcttatattgtcagcgtttccgctggtagtggtgcccctggtgagactcgaactcacactggacgggttttgaatccgttgcctctgccaattgggctacaagggcatcaatcaattgcagaactaacccggttgtttccgagccagtctgaatgactgaaagcaatattagaccatcaatgattaggaatggaaattaggggtctggtttgggtgaatgtgtcgctaatttttccactcgcctacactcgggaggcgtgactgagaagactgaccagaccttaatgcttatcgacggccactcgatggctttccgcgcattctttgctttgccggctgagaatttctccacgtcgggcgggcaggccaccaatgctgtctatggctttctctcgatgctgtccacgttgttgaaggatgagcagcctactcatgtggcggtggctttcgatgtggggcgtaagacgttccgtaccgatatgttcccggcgtataaggcgcagcgtgaagcaacgccacctgagtttaagggccaggtggaaatcctcaaggaggtgttgtccactttgggaattacgactattgagaaaatcgattttgaggctgatgatgtgatcgccacgttgtctgtggcggcgaaacctttaggctttaagacgctgattgttacgggtgaccgtgattccttccagttggtcaatgacaccaccacggtgttgtatccgatgaagggcgtgtctgtgctgcaccgtttcacgccggaagcagtggaggagaagtatggactgacaccgaggcagtatccggagtttgcagcgctgcgtggtgatccttccgataacttgcctaatattcctggcgtgggcgagaagactgctaccaagtggattgcccagtatgaaactttggataatttgcttgatcacgctgatgagatcaagggcaaggttggcgccagcctgcgtgagcgcattgagcaggtccggatgaaccgcaagctcacggagatggtgaaggatctggagctgccgcttggtccggacgattttgagatgaagcctgtgcaggttgcggaggttgcggcgaagtttgacgatctggagtttggtaccaatttgcgtgagcgggtgctggcggtggtgaaggccgagggttccgctgcccccgtggaggaagtggaagcggaacaggttgtcgtcgatacgcaatctttggcgcaatggctgcctgctagggctggccaggcgcttgctttagcgctggctggagtggctaaacctgctgctggcgacacgtatgcgctagcgattgcggataccaagcgccatgcggtgttggttgatgtggctgatatttcagcggaggatgaaaaggcgctggccacgtggttggcgtcggaagatccaaagatgctgcacggcgctaaggccgcctatcatatgctcgctgggcgcggttttgagctgcacggcgtggtgcatgacacggcgatcgcggcatacttgctgcgtccgggccaacgcacctatgagcttgccgacgtctaccagcggcatcttcaacgacagttgtctacaaacgacaatggcggccagctcacgctgctcgacgcagctgatgaccaatcgcttgttgatgatgtcattgcaatccttgagctgtctgaagaattgaccaaacagcttcaggagattcaagcttttgagctttaccatgacctggaaattccgctgtcgggaattctggcgcgcatggaggccatcggtatcgctgttgatgttgccactttggaagagcagttgaagactttcattggtcaggttgctcaggaagaggaagcagctcgcgagctcgctgaggatccaaccctgaatctctcgagcccgaagcagctgcaagtggtgctttttgagacgttcggaatgccgaaaaccaagaaaaccaagaccggctactctacggctgccgcggaaattgaagccctagcgatcaagaatccgcacccattcctagatcacctgttggcacaccgtcagtaccaaaagatgaagaccactctggaaggtctcatccgtgaggtggctcctgatggccgtattcacaccaccttcaaccagacggtggcgtctacgggacgtttgtcatccactgatcccaacctgcaaaacattcctgtgcgcactgaggctggccgaaagattcgttcgggattcgtcgtaggcgaggggtatgaaaccttgctgactgccgactattcgcagattgaaatgcgcgtgatggctcacctttcccaggacccaggcttgattgaggcgtaccgcgaaggcgaagacctgcacaattacgtgggttccaaggtgtttaatgtgcccatcgatggcgtgacccctgagctgcgtcgccaggtcaaggccatgtcttacggtctggtgtacggcttgtccgcgtttggtttgtctcagcagctgagcattcctgctggcgaagcgaagcagatcatggagtcctacttcgagcgcttcggcggagtacagcgctacctccgggagatcgtggaggaggctcgaaaagctggctacacggaaacgctgtttgggcgtcgtcgctacctgccggaactgacctcggataaccgtgtcgctcgtgaaaacgctgaacgtgccgcactgaacgccccgattcagggaactgccgcagacatcatcaaggtggccatgatccgggtggaccgttcactcaaggaagctgccgtgaaatctcgcgtgctgcttcaggtgcatgatgaattggtcgtggaagtagcggccggtgagttggaacaagtccgtgagattctggaacgcgaaatggataacgccatcaagctgtccgttcctttggaagtttcagctggtgatggcgttaactgggatgctgcagcgcactaagaggtaactgccttttcgtcgacgagctgggttgggcgctcgctactctttcgggtttcgtggcgcttcagcagtgtgaccgcaaagatggtggccagcgtcagcgtcacggtggagagcaagaatccgaagtgtgcgcggtcgctgatcatctctgatgttgcatcatgtccgatgacagcgacagccaaggaggagaacacacccaaaccgaaggtgccgccgatttggtgaagggaattcaccaggccagaaacggcgccggattggtccttcggtgcaccttgaactgccagagctgtcattggtccgaaagcgaagccttggccaaatcccaccaaaactattggtaggatcagcgcgatcatcgtgtttggtacaaatgcgaggcctgccatgccgatgaccatgatggcgaaaccgatgacggtgagcatggaatcagatacgcctgctcgggaaagccgtggcaccatcgcggcgctggcaaactgcagcagagatagcggcatgaacgcaaggcctgcctggagagcattcattcccatggtgtcctggaacagctgggtggcaaagaagaagaatgacatcacggagccaaccagaagaaagcggctggccaagatggtgtttcgcctgcggtttttaaagagccccaggggcagaagtggttctttggctgaggattcatggcgcaggaaccagatgaacactgcgatgcccagcacgagggaaatcaacacaaacggatctgtccagctgtaatcggcgctgcggacaattgcgtagagcaccgcggcgatacctgccgtggaggtaattgctccgaagatgtcgagtgatccaggcctgctgaaggttgcgggaatggctttgtgcactatgtaggccaacactgcggcgatggggacgttgataaagaagccgatgcgccacgacaaaagatcagcaaatacgccgccgatcactaggcctgctgccacaccgatgccggcaacagcaccataagcagaggtagcacgaaggcgagctgggccttcggggaagaactcagtaatcaacgcaagtgtcgctggagcgataatcgcagctcccgcgccttgaactacgcgtgctccaatgaggaccgcagcatttggagaaagcgcaattgccaacgatgaagccgcaaacaacgcgagaccaatgtagagcactttctttcggccgaagatatcaccggcacgagctcccagcagaagaagtgcgccgaagactaatgtgtaggaactctgcacccatgacaggtgcacgggatcgatgccaagttcactgccgatggcaggtagacccgtaatgacgatggaggtgtcaagcagaatcatgaagtagcccaaaaggacgatgcttaaaatcatgtgactaatttttgatggcagcaagaaaacgcaacagtgatcgcttatgccggtactactggtacctgtttaaaagtcagccccaacgcctatgttgaagatatggatgtacacgcagatactcgagaattcctcactgcgcgccgcaatcgtctcactccaaaagacgccggattgcctatttaccaaggcaaaaggcgagttccggggcttcgacgtgaagaagtggccatgttggctggcgtgagcgtggactattacacacgtcttgaacgaggcaacttgagtggtgtgtcagaacaggtgttaagcgcgttagctactgccttacagctggatgatgcggagacgcagcatctgtttgatctggccaagctcagtaattcaccggcgtcacggcgtaagcgtacccctgcaccgaagtctgtgctgcgccctgaggtgctgcgaattctcaattcgatgcacgatattccagcatatattcgttctgaaagccgtgaccttctggcagccaacacttttggtcgtgcgctatatgcaccgttgtatgaaagcacggtctccgatggaattagtggggaaccggggtcaatcaatgttgcacgctttacattcctcgatccagcagcgcgcgaatttttccctgagtgggagagaacttcggcagatttggtagccagcttgcgcaccgttgcagcacagcggcccaacgacacgttgtttagcaatttgatcggtgagctggtgaccaagtcagaagtcttcgcgcaaatgtgggccgaccataatgtccgcatgcatcgaacaggttccaagaagatcgtgcacccgttggtgggggagatggagctggattttgaaacgcttgatcttccagcagatcccgatattgccctcgtggtgtactccgctgcggaaggttcgacatctgcaatgaaccttcaacttctggccaattggacaggtaatgacagcccctccctcagcacagaacttggtgacactatttaattatgactttcacactgaacaacggactcgccattcccgacattggatttggtgtattccaaaccccacccgatgaaacccgaaactccgttaacgctgctcttgaagccggctatcgccacatcgacaccgccgccgcatacggcaatgaacgtgaagtcggtgaagcaatcgcagcatccggcattggccgcgacgagatcaccatcgaaaccaaaatctgggtgaccgactacggcttcgaggaaactctccacgcattcgacaaggccacaggcaagcttggtgtcgatacactggacattttgatcttgcaccaggcagtgccaagcagctttgatcgcaccatcgccgcctacaaggcgctagagaagctgcttttcgacggcgcggtgcgggcaatcggagtcagtaatttcatgccagagcacctggacaaactccttttggaaacctccattgtcccagctctgaaccaaatcgaatgccacccctacttccagcagcgtgacgtgcttgcccgcaatgagcagcttggcattttgactcaggcgtggtcaccaatcggtggcatcaccttctaccgcgacggacagcttccaagcactctagaaaatgaggtcatcgctggaatcgccgcagaagttggcaaaacaccagctcaagtaatgctgcgctggcacctacagcgtagacgtcacgcaattccaaagtctgtgaccccatcacgcattgtggaaaactttgagatctttgatttcgaactctccgatgagcaactacagcaaatcgatgccctcaacaccgatctgcgcggtggcccagaaccagagaacatcaccatggaaaactactaccgagaaatcccagaagcctaaaggcccttagaggcgaatgtaggcctatgtattttatgcctattccggcgggatttagacctgaccagaacatgtggccaatgagaggggtaaaggggagctgtcggccatatgggatggttactagtcgtcgaaaccagaccatatggccagcgacctctcaatttcgacttcattggtcacctggtttggtcggtccatccagagaccaaaagctcggaaattaggggagcgcttggtctgattcgacagttttgagcaccaaaaacgtgcattcgagaccaacagcagcttaaaaatgagcgccgttggttttttaggggcggtacgtggcgaggaagattgctgtcccggggaagagctttcctcgaagtggtgaccattggccccagttttcttccaactcatctggccattctggttcgatgaggtgatctaagtggagggaggcgtcgataagctcattgatccgcgcgcccatggtgcggtgctgttccgcatagcttaaagcaccggtttcctcgtcttcttcgacgtagccgcgctggtcgaagtagctggtgatcgcggtgaggcctgcggggccgggatcgtcgaggaaaatccagcgcatcgggtgggtgatggagaaaatgaggcgtccgccgggtttgaggacgcgcgcgatttccttcatgagtgcggcggaatcctccacaaaggggatggcgccgaaaacggaaaagaccacgtcaaaggaactgtcggcgtaggggagtgacattgcatcggcctgtacgaggtgtacgttatggtcgtgacctgcgtatttgagcatttgtgaagaaatgtcgaaagcggtgacaaaggcattcggaacatcattggccagccaccgagcacacggtgccgagccgcaaccgatctctaaaattttcttgccggagagtgctgcgggagtgccaagaagacgtacatctttttcatgcagcatctcggggcaccagtagaactcgccgtgagcggaatccgtgcctaaataagaagggtggcgttcgtgatagtcggccgcgtccacatcccaccagtatcggtttgcttgagagaactggctcaattggtggcttgaggttttcccattggtcccatcagtatcgtatgtgcccatttttgccattctatttgctctagctgcgcaaacggcgtactgtttattaggcgtgtcgttgcgtcatgtatcggtgtgttcatgtaggaaagcacattgagcctgaacgtgagatcaaaaccccgtctatacagggcatttgaaagatactgcatcctgtccattatctaatttcctatccatttcggagcaatttacatatgcccaccaacaatgcacctcaggtagccatcaacgacattggctctgctgaggacttccttgcagcaatcgacgcaaccatcaagtacttcaacgatggcgatatcgttgaaggcaccgtggtaaaggtcgatcgtgacgaggtacttctcgacatcggatacaagaccgagggtgtcatcccatcccgcgagctgtccatcaagcacgatgtcgatccagacgaggtcgtcgaagtcggcgaccaaattgacgcacttgtcctcaccaaggaagacaaagaaggtcgtctgatcctttccaagaagcgtgctcagtacgagcgtgcttggggcgccatcgaggagctcaaggaaaaggacgagccagttaccggtaccgtcatcgaggtcgtcaagggtggcctcatcatcgacatcggtctccgtggcttcctgcctgcatccctcgttgagatgcgtcgcgtccgcgacctggatccgtacatcggccaggagctcgaagctaagatcatcgagctggacaagaaccgcaacaacgtcgttctgtcccgtcgcgcattcctcgagcagacccagtctgaggtccgctccgagttcctgcaccagctccagaagggccaggtccgcaagggcgtcgtctcttccatcgtcaacttcggcgcattcgtcgatctcggcggtgtcgacggactggttcacgtttccgagctgtcctggaagcacatcgaccacccatctgaggttgtcaccgtcggcgacgaagtcaccgttgaggttctcgaggtcgatctcgaccgcgagcgcgtctccctgtccctgaaggctacccaggaagacccatggcgcgtcttcgctcgcactcacgctgtgggccagatcgttccaggcaaggtcaccaagctggttccattcggtgcgttcgttcgcgtcgaagagggcatcgaaggcctcgtccacatctccgagctggctcagcgccacgtcgaggttccggaccaggttgtcgcagttggcgaagaggtcatggtcaaggtcatcgacatcgatctcgagcgtcgtcgtatctccctgtccctcaagcaggctgacgaggactacaccgaagagttcgacccatccaagtacggaatggctgactcctacgacgagcagggtaactacatcttccctgagggcttcgacgccgagaccaacgaatggctcgaaggcttcgatgagcagcgtcaggcttgggaagctcgctacgccgagtccgagcgtcgcttcaccgctcacaccgctcagatcgagcgtcgtcgtcagcaggctgaagaggcagctgccgaggctccggccggcaactactccactgattctgcagaagatgcacctgcagcagaagcagttgaagagtccgctggctccctcgcttccgatgagcagctcgctgctcttcgcgagaagctcgcaggtaactaatagttcctgcacctcttaagagggctcactgacgttgacagtgaaccctcccaaagagtttgctccgcataaacaccccgcactttttaaccttcacggtttgggaagtgcggggtgttttgttgtgaggcttggttttcgtacggtgtggttaagcttttggcgggcgcttcggcgaaaatacatgggcctacaacgccgtctaagcgtgaaactgggggatggggatacctggaatcattcggggacgtgatgcggtggaggggtggtgcgggcataatctgacagtgtgtccgttttcattttcaaaaaatgcaggtcggacatattcaaaagtattacctttttggtttgtctgtattcagcttgttttgggtgggtttccggcttatcatgatgggtgacttaccgcttaattggaaaaaagtgtgatccaccacaaatctattgcgggggagcctgggaaactaggtaaaaatttttgccaaattgtgcaatcgttttcacaacctgagaatgtcacaacacattaagtggtaggcgctgaggaatcgaatccgattctttttcggcccaattcgtaacggcgatcctcttaagtggacaagaaagtctcttgcccgcgggagacagaccctacgtttagaaaggtttgacatggcgtccaaactgacgacgacatcgcaacatattctggaaaaccttggtggaccagacaatattacttcgatgactcactgtgcgactcgccttcgcttccaagtgaaggatcaatccattgttgatcaacaagaaattgactccgacccatcagttcttggcgtagtaccccaaggatccaccggtatgcaggtggtgatgggtggatctgttgcaaactattaccaagaaatcctcaaacttgatggaatgaagcacttcgccgacggtgaagctacagagagttcatccaagaaggaatacggcggagtccgtggcaagtactcgtggattgactacgccttcgagttcttgtctgatactttccgaccaatcctgtgggccctgcttggtgcctcactgattattaccttgttggttcttgcggatactttcggtttgcaagacttccgcgctccaatggatgagcagcctgatacttatgtattcctgcactccatgtggcgctcggtcttctacttcctgccaattatggttggtgccaccgcagctcgaaagctcggcgcaaacgagtggattggtgcagctattccagccgcacttcttactccagaattcttggcactgggttctgccggcgataccgtcacagtctttggcctgccaatggttctgaatgactactccggacaggtattcccaccgctgattgcagcaattggtctgtactgggtggaaaagggactgaagaagatcatccctgaagcagtccaaatggtgttcgtcccattcttctccctgctgattatgatcccagcgaccgcattcctgcttggacctttcggcatcggtgttggtaacggaatttccaacctgcttgaagcgattaacaacttcagcccatttattctttccatcgttatcccattgctctacccattcttggttccacttggattgcactggccactaaacgccatcatgatccagaacatcaacaccctgggttacgacttcattcagggaccaatgggtgcctggaacttcgcctgcttcggcctggtcaccggcgtgttcttgctctccattaaggaacgaaacaaggccatgcgtcaggtttccctgggtggcatgttggctggtttgctcggcggcatttccgagccttccctctacggtgttctgctccgattcaagaagacctacttccgcctcctgccgggttgtttggcaggcggtatcgtgatgggcatcttcgacatcaaggcgtacgctttcgtgttcacctccttgcttaccatcccagcaatggacccatggttgggctacaccattggtatcgcagttgcattcttcgtttccatgttccttgttctcgcactggactaccgttccaacgaagagcgcgatgaggcacgtgcaaaggttgctgctgacaagcaggcagaagaagatctgaaggcagaagctaatgcaactcctgcagctccagtagctgctgcaggtgcgggagccggtgcaggtgcaggagccgctgctggcgctgcaaccgccgtggcagctaagccgaagctggccgctggggaagtagtggacattgtttccccactcgaaggcaaggcaattccactttctgaagtacctgacccaatctttgcagcaggcaagcttggaccaggcattgcaatccaaccaactggaaacaccgttgttgctccagcagacgctactgtcatccttgtccagaaatctggacacgcagtggcattgcgcttagatagcggagttgaaatccttgtccacgttggattggacaccgtgcaattgggcggcgaaggcttcaccgttcacgttgagcgcaggcagcaagtcaaggcgggggatccactgatcacttttgacgctgacttcattcgatccaaggatctacctttgatcaccccagttgtggtgtctaacgccgcgaaattcggtgaaattgaaggtattcctgcagatcaggcaaattcttccacgactgtgatcaaggtcaacggcaagaacgagtaacctgggatccatgttgcgcattggactaacaggagggatcggcagcggtaaatctaccgttgccgatcttttgtcatctgaaggatttctcatcgtcgacgcggaccaagttgcccgcgatatcgtcgaacccggacaaccggcattagcagagctagctgaagcttttggccaagacatcttaaaacccgacggcactctagaccgcgcgggattagcagccaaagcatttgtcagcgaagaacaaacagcgctgctcaatgccattacccaccctcgtatcgccgaagagtcagctcgtcgattcaacgaagccgaagatcaaggcgccaaagttgcggtttatgacatgcctttgcttgtagaaaaaggccttgaccgcaagatggaccttgtcgtcgtagttgatgttgacgtagaggaacgcgtccgcagacttgtggaaaaacgtggcctcacagaggacgacgtgcggcgtcgaatcgcttctcaagtgcccgacgacgtcagacttaaagccgctgacatcgttgtggacaataacggcacgctagaggaccttcatgctgaagcaagcaagctgattgctgagattcttagtcgcgtgaattagcactaaaacatcgtcaaagtcgatctaccaagaaagccctcggaacaatgcaattacatcagttccgagggctttttcgtttgagtgctggtgatgaacgagtgatgagcgagggcagtacccatttcctcagtttcaaccaatcgcggaagtaaggggctgggggattcctcaggatagttttatcttgaagctgggagatccgtggcttgaaaaggtaacttgacccgtttactcacaaggggaaccggattacataccagaagattaatacttgaaagtagggttaaccgcgctctgatctggtacttctgagatagtcagcaaatctgatataggaaaactccttatcagaggaagtatagattgtgaattttgaaggattacgcggtgcatactcgtgggttagtttctctcttaagtcttatttttcttttcgttctttcagggtgtggagggaatgccactaccgctgatgaagctgctgaaagtgacgttgttacttcaagtagcgcacctccaagtaaacgagctctagatgttggagaagcagtagagatcccaggggtcgtgctcacggtaaacagcgtcacacagtccgatcagctcatgttgtactcagaaggcagtgcgcgtggatctgagccgagagaacagcggaatgctgcgtccggagaaaagtttgtttcggtggacactaccgtgaagaattcgagctctgatccttgggatctttcatgtggtcacgtattacagacatggctcctcgaggacgaactagatgatcaacaaggtgaccaagaaaagaaatttagccctatcgacaatcttgatcagatttctggtaatccggagtgtggtgtgcttttagaagtgggtacagaaattgaaatgacgtggtcttttactattccagatgacatagaaatcactcactttggtttttctctttcggatagcacttccaatgacttggccattatcagccttgggggtgcaatagagacatcgtcggccatcacaacaactgaagttatagcaccggaaaatgacacggaaacgctgctagagataactccggttgactgtcaggtcggccttggccccatcgttacttcttggtcggatggaacggtcggaggttggtctcagcactgtcaggacgtgcatgatgaggtacttgccggtgaagtcgcagcgaataccccagtatgtgacggagttgtatgcacttaccccagtggcgccacaatgccggatccaaatgcacctcaaatcccttcagatacgagtggtgcagtgtgcgatgaaaatcagtgtgtttaccctaacggttatatcgcccgaattggggatccgaatgttccgaactatctcaagcctggcaactctccgtgggtacaaggacagattgattttcagaattgcctagacagtgggaaaactattgagcaatgccgtgaagaactgaactaggtcagtcttaagaaatcacccagcccgaagctcagcagtatgcgattgcagtcttacctgaatcgcactgatgagggttgcgtggtgttgattgcagatctcaatctcatgagccaggtccgtaagatccacctgagcagaggctttgatacgctgttccacttcgagtgctttatcgcggacctgctccaattggagcccaagttcagcggaggaacgcaaaatgtcggagttatcgctgttggaggtgaggaattctgaccaagttcccaacacagtggttaggtgattttgctctttgagtacggagtttcggagtttttccaagtcttgatgaatagcgtgggcgtcagtagaggtcgggacagtaaaggcccgcggtacgatgtcttcccggctgaggtcactgtgttttttatctgcaagctggtgcaaaagtgaagtcaaggccatgtgggtgactggcgcccaacgtttttcaacgctgcgctggtgaaatcgaccaataaataccgtcgtgagcaaaaagtgactaaaccagcggcaagtccggacagaatcacgatttcttgccagaatcctgtggagatatcgatccacaaaatgatgacaatgagcgccagcgcgccaatcaccgtgacaacgtgcagagcggaagccttgctcaggagagtacgcatcgattgcctcatttcaatttgtgccagctagcaggaatgacctcgaccatatccgacttggcccgggtgcgagcgcaaaagatttttgcttttcgacgtccactagcagcgatatccacaaaaggagggcgtaccctcaccaatcaggtgcggatacgccctctaacaaccttgtgaacaggtctatccgatgcgctttactgcatcgatcaccatgttccagaatttatcaaagtccaggtcaacagctacttgggtggtgcaatctgctggagccggtgcgcggaaatcagcaacggtcatgcctgtggtgagtgcgccgtacagctccacatcgagtggtgctttgcgggtggtgaatacggttgggtcaacaaggtatgcaacagcacaagggtcgtgtactggtgggttatcaaaaccctgtgcgtcctggtaattcttgcggaaagcgtcgaaaagcgcgacgacgaagtcggcgacgtcggtgcccagctcgttgaacttggcttcgatctcaggtgttgcgagcgcctggtgggtaaggtcgaggccgaccatagtcagtggccacttttcgttgaatacgatgtgggctgcttcggggtcgatcttgatgttgaattcagctacggcggtccagtttcctacgtggtagcccccgcccatgaggacaacttccttgactcgctcggcgatgcgtggttctttccggactgccagcgcgatgttggtcagtggtccggtgggaaccagcgctacgctgccgggctcgttattcatgatggtatcgatgatgaaatccaccgcgtgggtgtcttctacctgcttggttggttcaggcagttcgtacttgtggatttccatgccggtatcgccgtggatatcttcggctacctcaacggggcgcaccaatggtcgggtgacaccgcggtagatgggcgcattgatatcagcgatggtggctacgacctgcgtattgtgggtgaccttgtccaaggtctggttgccgccgaccgtggtgattccaagcagttcaatttctgggctgccggctgcgagcagcatggctacagcgtcgtcgtgtcctggatcgcagtcgaggatgatcttggtggtcatagggtaaaactccttagttcagtttgtggatttagctggcggcttgagcggcttcttcagcctggactttggctgccactgtatcggtgattgattctgggcgtgggatcagcagggagcagaggaaggctaggaccaagatgatcacgccagcccacatgcctgcggcgtatcctccgccgttgtcactgaatgccgtggaaactgcgaagaggatggcgaaggaaatacctgcacctaggttgaaggcacctgcgttcatgccaggcagatagccttggttgttagcaggggagagcacgatgcccaggccgttgagcatgatgttggcaatacctgcataggtaatacccacgaagatggagatgccgaggtacgcgagatgcgaggtgcttccgactaagaaggtggctccggcaacgccgatgatggtggcagcgataccaatttgcaggacgatcttgtatccaaattttccggcgagaattccggcgattggaccgaataccaagccagccagcgcatatggggtaagtgtccaccaggacaccacgctcgctgacatgccggcaccgttggcagcatcctgcgcaaggttgggcagcagaccattcattacggcgaatacaccggtcattgtgagaagggtgctcagcagcaatgcccaggtgcgtcgttgaccgaggtattcaacactgaccagcgggtgcttaacgcgcttttcaatgttgtagaagaagatgactccggcgataccgatgatgaacagcacaaccaccagaatccagttcgcggcaccgagtttgccggcctcgttgaaagccatgagcaaagatccaatggacaccgccagtggcagcacaccaagccagtccatcttcggggtttcttcagcggtggattccttcacgctgaaaggcagtgcgagggcagcgacagcgcagaaagcagccatgacccagaagatggaacggaaaccaagtgtttcagccaaccagccaccagcaagcgcgtccacgccgccgataccaccgttgacagaggtaacaattccgagaagtagcgcatattgcttttcattggttacctgctggcgcagaatgatcagacacagtggcacggttgggccagcaacaccttgaatcaggcggcccaggaagaggatggtcacattcggagcaaaggcagcgacaacacatccaataccggtgacaatcatcatgccgaccagcactttgcggcgaccaatcagatcgccccaacgtggcaggaacagggaaaacagcgccgccgcggtgaagaaagcagtctgcgtcatgccgatttgggcagctgttgcattaagttcagtttccatggtggccagtgccggcgccagcatggaggcgttgagctggaaggcgaataccgcgaccagcagggcgatcatcaatggtatgactgtggcggccgaggttttactcggctgaacaggaagtgacatcagtgttctcttttcagtgagtggttgaggggaggtcagtggtcagggtggggtaggaggcttgagcgcccggcctcgtggcggcataagcgccaacgcgcgcagcaaaagttgccgcctcaataaggccagcgccttcagagagctttgcgacgagtgcccccgcaaacgcgtctccacttccggttgtgtcgactgcctggatctttggggtaggaattgccgtgagttggcccggcgtgccaaccagagcaccttcggcaccaagtgtcatcaccacggaagtaaaaccctgctccagcaattcagtgaccaaactttggggatcagacgtggtcgctggagttccaagcatgtccagcaccagagcgccttcgtgttcgttgaccagcaatggatcggcacgacgcagctgatcatgtcccacgggcacaactggagccagattgatcaccacacgtccttgtgaaagatcaacggcacgctcgaaaccatcggcagggatctcaccctgaagcaacacaatgccggcgttctcaatgagttgggagtgtttatcaacaaattccgcggtgacagaagcgttagcgccagggataacgatgatggtgttttccccatcgtcagacacagtgatgatggcaagaccagtgggaccgtccacagtggcaatcgcggacatatctgctcctgattgacgcaaatgtgtcagcgcctcgccagccatttgatcggttccgaccgcaccgatcatggtgactttggcacctaattgcgctgccgccacagcttggttggcgcctttgccaccagcactcactgtgccgccgctacccaggagggtttctccaggttcagggtggcgttgaacttttgcggtgagatcggcattgatggatccgacaacgacaatgtcggtaccggttgagttactcattggggagtccatccttcttccttaaagtggagttgatgattgattcacgatgaataagggcagtggggatcgtagttttcgtcacgctaggtaccgtgcctgcaattaattcggtgaggatagacactgctcgttgggctagttgttctacattttgatcaatcactgtcaacggatgaggttgcagggcaaaaagcggatgtgtatcaaaaccaatcacgctgacatccttgccgataaccaaaccagccttatggcaggcttcaatgacaccgatcgtcatcatagaatcgccggcaaaaagagttttagctccttgatcgagcaatttcgtagcgccttcaaatccaacgctttgttcgtacccacccagaaaaacgagctgttcgccaattttggagttggcgcaggctgctttgaaatcctctaatcgctctctacctgttgaggtgtccatgggacctgagaggtaaccaatcggcaacgcgttgttgtgagccaggagttctactgctgcggcgattcctggttgggggttagaggtcgccgttgggatggtggagtctcctggaagctctcggtcaaccaacaccactggcattccttgcttctgcaagtcctctagttgattcgcgcattcctcattaggtacgcagatgattccatcgacaccatgcgaggtgagaaactccaaagacccagacatagtggtcgcatcttcattgctgttggtgataatcgtggcaagtccagctttgctggcggtgctttgaatttcagtaaccattgcggcgaagtaatggttaatcaaactgggaacaatcacaccaatggtgttgctgcgagaactgcgaagcgcacgagcttgagcattggcccggtaacccagatcagaggctaattgttggattctttcacgagtcgatgcagcaaccgccggattatccgctagtgctcgtgatgctgtggcgatggagacacctgcttgacgagcgacatctttaagagtcggtcggaatttttccgtcgccatagcgcctcgctttatctcattatctacctttatgtaatcgattgctgcaaacgattacattcacttgtgttttaacctattacgtgcaaggcgatgttggcaacaggggtaggaagtgggggtggtgatcccgggaagtgaataagaaggctaatgatttaaaaccgcacttcatgagacgtcgggcaaagtatggggtacttatggagtctcacggggtaggttcatccacaacccttgcgagacttcacattccgctaatgacaggagccggaaacatgccatttgatccagtgggcgaatgggtagctaaatccattaaccgtgaacttgatgagtatccgatgacagaggccgaagtgctagaaatctgttttaggcaagggcagtacaacctgaagatggaataccggatttcaggacgaaagtttcatgtagatcgtggatctgccgaatattcactacgttttaatccttggactttagctcaaagcgaaaccagtacagatgctaatggggaagaaactacctttacgatgtccccgaagttgaccgcggatggttggttcgaaccaggggaggcggtatcaaagtccatttttatgggcagtcctcaactactgcctaggtggacgcaatttgtcaccaacaaattgtattcgcgactaggggaggacccgctcaagatcacgatgctcgactccaggtacctgaaaattgttcaagcagcaacggaagaggatccagggtggggtctctttgttgattgggttcatgattgcgggctttatttttgtcgatacggcctgaatcgggagatgtatcaggaggtggaggcaacgtctgtgcatcaatggttatccggcgagactagttttcgtgaacttgagagggatgaaattggtgagctacagattgtgaattcatctactgactagctaaaggtggctagatcaggaaaaggaatgtgcgtacttgaggaggaatatgatgtcgaaacttcgaaagaccatccagctaaatcctaactatgggtcgccattcggactgtggtcaagccatcccattcgccctccgtatcagggtgcctttttaacgccggacagctttctcttaagtgaggatctgaaggatcgaatggctgcgtggctgaaattatggcgagaaaattatgcgaatgttgttgaagaagagtcaaaccaatggacactaggtttcgatcaacatgcttgggcggaagaggggcacgttattgccgacttgattgaggaggaagctcctggttatgaagttgtgagaggctttctttcctacttatagaaaaacacagttgcatcgagtccgcgggtttcgcacgcttgatctaaattcttgagggttttccggccgttgtttgcgctaaacgtaggggtcaagcgtcgaaaagcgcttgcttgcacgctgttttgctgcgggccgcaacgtgtccaccctgtggcgtatcctagaatgcatggcttttgctgctgaacatcctgtcctgtcccactctgagcaccgcccggttggtgaaatcgagcgtagcgatgacaaatttgttgtcgttagtgaatttgagcctgcgggtgaccagcctgcggctattaaagagctcgatgagcgcttggatcgcggtgagcgggacgtcgttttgatgggtgctactggtacgggtaagtccgcgactgcggcgtggttgatcgaaaagcagcagcgccccgctttggtgatggcgccgaataagacgctggctgcgcagttggctaatgaattgcggcagctgttgcccaataacgcggtggagtatttcgtgtcttattacgattactaccagccagaagcgtatatcgcgcagactgatacctatattgaaaaggactcctcgattaatgaggatgtggagcgtctgcgtcactcggcgacgtcgtctttgctgagtaggcgagacgtcgtggttgttagttcggtgtcgtgtatttatggcttgggcactccacagtcttatcttgaccgttccgttgtgttgaacgtgggggaggagatcgaccgcgatcgctttttgcgcctattggtagatattcaatacgaacgcaatgatgtgggctttactcgtggtgctttccgcgtgaagggcgataccgtggacatcatcccggcctatgaggaattggcggtgcgcattgagtttttcggtgatgaaattgatgcgttgtactacatccatcccctgactggtgacaccatccggcaggtgaatgagatccgtattttcccagctacgcactatgttgcgggacctgagcggatggaaaaggcagtcgctgatattaaggcggagttggaagtgcgcctggctgatttggagaaccgtggcaagttattggaagcgcagcgtcttaggatgcgtactgaatatgacttagaaatgatcgagcaggttggtttctgttcgggcattgagaactattctcgccacattgatggacgtggggagggaaccgcaccggccacgctgattgactatttcccagaggatttcctcaccatcatcgatgagtctcacgtgacagtcccgcagatcggcggcatgtttgagggcgatatgtcccgtaaacgtaacctcgtagaattcggtttccgcctgccatccgcgatggataaccgcccattgacctgggaggagttcgatgaacgccgtggccaaacggtgttcatgtctgcaactccaggcaagtttgagatcgctgctgctgatggtgagtttgtggagcaggtcattcgcccaacaggtctggtggatccaaaggtcaccgtcaagccaacgaaggggcagattgatgatctgatccatgaaattcgccaacgcaccgataaagatgagcgcgttttggtcaccacattgaccaagaaaatggctgaggatcttactgattacctgctggaaaacggcatccgcgtgcgctacctgcactcagatattgataccttgcagcgtgtggaattgctgcgtcagcttcgcctgggcgaatacgatgtgttggtaggtattaacctgctgcgtgagggccttgacctgccagaagtctctctggttgcgattctcgacgccgacaaggaaggcttcctgcgctccaccacctcactgattcagaccattggccgcgccgcccgaaatgtgtccggcgaggtcatcatgtacgccgacaagatcactgattcgatgcagtatgccatcgaggaaaccgatcgacgccgtgaaaagcaggtcgcttataacaaggaacacggcatcgatccgcagccgcttcgaaagaaaatcgcggacatcctcgaccaggtctatgacaattccgctgatggagcaggaccttctgcctctggcgatgcggcagtcgtggctaaacctgacgtgtctagcatgcccgccaaagaagtgcaaaagcttatcgacgacctcagcgctcagatggctgcggccgcgcgggagctcaagttcgagctggcagggcgtctgcgagatgagatcttcgagctcaagaaggaactgagaggtatcaaggatgccggcatctaagtcagcttgctcacttaaagcttcgaaataagcccttaaactctcattcttttgttagacttgttcactaattacagacatccaggggcttagatttttaacccctgtcataagtttttgggaaggtcacatgagcgagaattacagcaagattgtcgttggcactgatggatctaagtcgtcccttctagcagttgaacgagctgcccgaatcgccgcagctttcgacgccactttgatcatcggatgtgcatactacgaaagcaaggaagacgcttcagagactttgcgccaggattctgtaacaatcctcggcgatgatcctgctcgtgaaaacctggacaaggcagcagatgcagcacgcgctgtcggcgcaacctccatcgagactgaggttcgtactggcactccagttgaggctttgatggcaatcgttaatgatcaccaagctgaccttcttgtggttggtaaccgtggaatcaactctttgaccggccgtttgttgggttcagttccagctgatgttgcacgccaatcagactgcgatgtcatgattgttcacaccgtgagctaaaaaaaccaaaccaaaaccggtgtttccctccttttgcattgaggggaacaccggttttgtgtttctcgaggaaagtgctcgggagtgttagtgctgcttatcgtagatttcttgcgccctaactacctgatccaattcagcttccacagtgctgactagcaggactaaagcgtccgcgagcttagtgcccaaaggtgtcagtgtgtagtccacgtgtgggggaatggagctgtggactgttcgatcaaccatgccgtcacgttctagttgggccaatgtctgcgacagcatgcgatcactaatgccctcaacttttcggcgaatttcagcgaaacgcatcggttcatcactgcgtttgagcgccaccattgtcaaagacccccatcgaccagtgacatgctgcaacgcgccacgtgaagaacacatggaggagaacacatttgccggttgctgaataggggaaatatccatggcgataatcctatccctaaaaagtttctaacaaaagtattgcacttactttttgatagtgctatcttcagttgtgtacttgaaacacacacgaatggagcaagaaatgcgtattgcagtaactggagcaacgggatctttgggtggacatgttgtggatagtcttctaaacaagggcgtcgcagcatcagacatcgttgccattgttcgaaatgaagaaaaggcagcagacctcaaagcccgtggaatcgctcttggtgtggctacttttgaagacgaagcggcactgactgcagctcttgaaggtgtggatcgccttgtgtttatctctggcagcgaagtggggcagcgcgttgcgcagcacaccaatgtcatcaatgccgctaaagcagctggcgtgacattcattgcatacaccagcttgctcaaccttggtacctcaaagcttgcacttgctccagagcacattgcaacggaaaagctcctggcagaaagcggcattgaccacgcgctgctgcgcaatggttggtactgggagaactacgaatcttcaattggcgcagcgaaggccaccgggaaggtattcggcgcagctgaaggcgcacgcgtttccgcagccgcacgtaaggactacgcagaggcagctgctgttgtcatcaccagcgacaaccaggcaggcaaggtctatgagctcgcaggcgcaccagctttgacctacccagagatcgcagctggcattggtgaggtcattggttctgaggcagaatacgtcaacctctccgtggaggagtaccaaaatgcgctggagcaggctggcgttccagctgaatttgcagcacttctcgcaggcatggatcccatcattgcagagggcgcgctgtactccgacagcaccgacctacaggatctcatcggacgcccgagcacctcaatcgttgaggccctgagctcataacctgctactcacctaaaatggtgaggctctgcgttgcacgagtgaccgcaacgtagaggtcttgcaatccctggggggattcttcaacgattcccgcaggatccaccacgatgacgtggtcaaactctaagcccttgatgtcatcgaccaggtagaaatcgctttcgtggtggcggcgcgaagaaatcaccgcgatggtgcgctgtgaatcctcctcacgcaaactatccatcactgccgacaaatcggcatcaagcggcaagttcactacctctcgaccagattcgcggatcgccattgccggcgcaatatcaggattgatctgcgtcaaaagctcattggccaccgacatgatctcggccggggtgcggtagttaacggtgagctcgtggtgcctgaaacgcttttcgacgaagggccacagtgattctgcccaatcgtcaacgccggcaggcgaaccagtttgagcaatatcgcccacaagggtcatccatcgcgaagggctacggcgaaacaccatgcgccattccatcggactgagctcctgagcttcatctacaatcacgtgaccatacgcccacttatgatccgcctgtgcacgttccgcagtggtgcgattatccgtgacagtttggcgttgtgccaaagtttccgcatcgatgacgtcgaaagcggagagaacttcagcttccgtgacatcatcaatatccgatgactgtgatgaactaagaacgtccaggacttcctgagcgtcatcgatctgctcgcgccatttggcctcagccttctcccgtgcctcctctggatcgggaagaccgatgagcagggctaactcatcaagcaatgcagcgtccgatggtgcccacggatcgagttcaccacgcagcaaagcagacttagtttcctcgtcataccccgcggcagcaacattaatgcgctcttcggaaatcaacagatcatgcaggacgtcctgaggccggagctccggccagaaatcgtcgatgacggactggagggccgcgtcgtcaagcaaatcatcgtgcagctgatcgatgtcggcggctgacagcaggtttttgccgcccagcggatccgcgccgatcgtttgagccatttggtgcgcgagttgttcgactaaatgctcgcggaaaattgggcgtgcggaattgtgcgactgcctggcacgacgagctcgggtgcgggattttgccaccgttttctcatcaatggaaatctcgatgccatcaacagagaccacgatggtcttctctggcagcacttgatacgccttgactgcctcggccaaaatgctggccatttcctcgctgcccttaatttccctggtcaaagtgtcctcggaacccgttgggacgataccggggaacagctcaccgacggtggacaacaccacgccagtctcgccgagttcaggcaaaacgtgagaaatatactccaaaaatgtcttgttcgggccaatgatcaacacgccagacttagccagctgatcgcgccaggtataaagcagataagccacacggtgcaacgcgaccgcagttttacctgttccagggccaccttgaacaaccatgacaccgcgggtggtatcgcggatgatctcatcctgctcgcgctgaattgtttcaacgatgttgcgcatgtggccgctgcgggcctgttccaacgcctggtgcagcacagattcagagccgacaccaccctgctcgataacatcggccatctcaccggtcaatacctcatcatcaacacccgtgacaacgcgcccacgggtgcgaatgtgccggcggatatgcacgccctccggtgaaacggtggtggccagataaaacgggcgcgccatgggggagcgccaatccaacagcaacgtgcggtaattatcttcacgcacatcaagacccatgcgaccgatataacgacgatccaaatcagggtggcccgggaccgggttctcagcgtcctcagcttcagactccacatcgattcgaccgaagaccaacccgagttgagccaaattaagccggtccaacttctcattcaggccgtgatactcagtttcacgacgaacaagtgcttccggatcagggtttgaggggtcgacgtctttcatcacctcagaaagacgctgattagacctggctacctcatcatcgaggcgaccgaaaagtacatcaacataagcctgttcttggctaattgctgtggtgagggcgttatggacatctgattctgaatcagattgccgaatggtggtcactccgggagacctcctgtttcctgatgtggagcagtgagaaaaagtgtttgaactggaatagatacaacacttgggagctatcaatcattccagatagcggttaaagcgggaacaatgggtgaaaaaccgccacgttaccccggcaattccagggataacgtggcggaaattttttctcaatcaggaagaagttacttaaagttcgatgcccttcagcttcttctgtgcacgatcgatggccttatcagcctgcttctgaagcttgtcgtagctcttagttgccttcttgttggcgcgaccagaggtttcctctgcgacctgaagagcaaagttagccttttcctgagccttgccggcagccttcactgcagacttacgagcagtcttggcgttagcctgcgcagcctcaagccagtcaccgctgttctcctcaaggtaagaggtagccttgtgagcgtaatcgctcacagtatcagcgaccttgtgagcagtctcggttgcggacttgatccagtcatccttgttctcaccgacaaaatcctgagcggtgtacgcgtactcggtgaccttgtcagaagtatcgttgaaccaatcagaggccttctcaccgaacttttcagtctcagatttggttggaagtgcctgctgcagctgcttcttgccacgctttgtagcattggttgcacgccacttcacgccaggcttgccctcagtatcaacagaagtgataaacaggccaccaagcagggcaatgttggtgaggaaaccgttgcggcggttacgcttttcatccgcatcctgggtttcccagaacgcattgcgagccaggatgttagggatagtcaggattgcgagggtagctgcagaggtgcgtggtgcacgaccaatagctagcaaagaacccgcaccgactttggtgccgccaatgacgcgggtgaccaattctggatctctggaaatgcgctttgcgtacttacggggcagcacataacggatacgatccagaactacctgagtgccttcgacgtgtgcgctggtgttcaatactgtttctgcgccatctgcgacgtagaccgatgcaagcattggtcgagcaagtttgcggatcattatggtgatgctccaatcaaaatactgttgtccagttttataagccgaggtgggccactggattgttttcagattttttctcctcgtccgatcgtacctaggtattggcgacgaggttggcaggtttccatcttttgcaggaaattctcaggaaagcacgttgtcggtgcgctgctcgaacagtgcctggttgagaaaagcgcttaccagcgacgctcccaccagatttccagctgtggacgctcggctccaagggtggtttccttgccgtgacctggccacacgatgctgtcatcgtcgtaggtgtcaaagatgcgctctttgacatcgttgaacagtcggacgaagtcgccttcgctgctggttttgcccaaaccgccggggaagaggctgtcacccacgaaaaggtgagttttaccgtcgatctcagcggtgagtactgcaccgcctggggtgtggccgcgcagaatgctgatagggaatacatgaccctcaaattcaattgaatcaccatgatgcagttccacatcaacagcggagggcaaagctggcacctcaaggaaaggcgcgtagtgagttgctccggtcttctggagaacctccggcaatgcacggacgtggtctgcgtggcggtgggtggtcaacactttggtgatggtcacaccggcatcttcggctaatttaagtagtgcagctgcgtcatctgcagcatcaatgagtaaaccgttgccatttgcggccaaaaggtagcaattgttgtccatttgggacacggaaatatggtgaagagtgagctcgttagtcatgtggttcagactagcggaaacaccttgttcgatgctatgttcgaaggtgtattttttgaagcgacaaaaatcgattttgaagggcagttgagcattggctgatcgcctcgtagtgcgcggagcgcgtgaacataacctaaaaggcgtggatattgatttgccacgcgactcgatggtggtgttcaccggcctgtcaggttccggtaaatcatcactggcctttgacaccatctttgcggaaggccagcgccgttacgtggagtcgttgtccagttacgcccgcatgttcttggggcagatggacaagccggacgtggatttgattgatggattatccccagcggtctccattgaccaaaaatccaccaaccgcaaccctcggtccacagtcggtaccatcacggaagtctatgactacctgcgtcttctgtacgcccgcgctggtaccgcacactgcccagtgtgtgatgcccgcgtggagcgtcaaaccccccagcagatggtggaccaaatccttggcatggaggagggactgaagttccaaatccttgcgcctgtggtgcgtacccgtaaaggtgagttcgttgatcttttcgcagatcttgcatcccaaggttattcccgcgtgcgggttgatggggaagtgcaccagctctcggatcctccaaagctagaaaagcagatcaagcacgatattgatgttgtggttgaccgtctgcaggtaaaagccagccaaaagcagcgcctgacagactctatggaaaccgcacttcgcctggccgatggcgtggctgtgctggagttcgttggcctggaggaagatgatccgaataggcttcgtcgattctctgaaaagatgagctgccctaacggtcacgcgttgacggttgatgagctggagcctcgtgctttttccttcaactctccttatggcgcgtgtcctgcctgtgatggcttgggtgtgcgcaccgaagttgatattgatctgatcatcccagatccagatgcacctgcaactaaagcggttcagccctggaactccagcccaaaccactcttactttgaaaagctcattgaaggcctggcgaaagccctcggatttgatccggaaactccgtacagtgagctcaccgcagctcaaaagaaggctctggtctatggatcgaaggaagaagtaagcgttcgatacaagaaccgctacggacgcgtgcgttcttggactgcgccttttgaaggtgtcatgggctactttgatcgcaagttggagcagactgattccgaaacccaaaaagaccgactgttgggctacacccgtgaagtgccctgcccaacctgtaaaggcgcacgcctcaagccggaaatcttggccgttcgcctagactccggaagccatggagcgttgtccattgctggactaaccgcgctgtcggtgcatgaagcattcgagtttttggataacctcacactgggcaagcgcgaggaaatgatcgcgggagctgtgctgaaggaaattcacgcccgcctgaaattcctgcttgacgtgggcctttcctacctcacccttgatcgcgccgcaggcaccctgtctggtggtgaagcgcagcgtatccgcctggctactcaaattggttccggtctggctggtgtgctctacgtcttggatgagccatccattggtctgcaccaacgtgacaaccagcgcttgatcactacccttgagcatctccgagatatcggaaacacgctcattgttgtggaacacgatgaagacaccatcaggcgcgcagattggctcgtggatattggtcctcgagctggtgaatttggtggcgaagtggtctaccaaggtgagccgaagggcattttggactgcgaagaatccctcacaggtgcttacttgtctggtcgtcgaaccctgggtgttcctgatactcgccgtgagatcgacaaagagcgacagctcaaggtggttggtgctagggaaaataacctgcagggcatcgatgtgaaaatcccactgggtgtgctgtgctgcatcactggtgtgtcgggatctggtaaatccacgctggtcaatcagattttggccaaggttctggccaacaaactcaaccgcgcacgccaagtgcctggtcgcgcaaagcgggtggaaggcctcgagcacttggataagttggtccaagtggatcagtcgccaattggtcgtactccacgttcaaacccagcgacgtacacgggtgtgtttgataaagtccgtaacctttttgccgagaccactgaagcgaaggtccgcggttacaagcctggccgcttctccttcaatattaagggtggacgctgcgaagcatgtcagggcgatggcacgctgaagatcgaaatgaacttcctgcccgacgtgtatgttccgtgtgaagtctgtgatggtcagcgctacaaccgcgagaccctcgaggtgaagtacaagggcaaaaacatcgctgaagtattgggcatgccgatctctgaggctgcggacttctttgagcccatcacctcaattcaccgatacctagcaacgctggttgatgtcggccttggctatgtccgtttgggccaggcagcaacaaccttgtctggtggtgaagcccagcgtgtgaaacttgccgctgagctgcagaagcgttccaacggtcgcaccgtttacatcctcgatgagccaactactggtttgcactttgaagatattcgcaaactcatgatggtgatcgaaggcctggtggacaagggtaactccgtgatcatcatcgagcacaacctcgacgtgatcaaggctgccgactggatcgtggacatgggtccagagggcggaagcggcggtggaaccgtggtcgctgaaggaaccccagagcaagttgctgaagttgcgggttcctacaccggccaattccttaaagagttgttgtaggagaagatgaggggctttcatgggaaggctcctcatttttatggctagtcgccccatgtctagccacctgaggtctagctacgtcggccttgttttctgaggttctccggcccctcatagcagcgattgtcagcagtgcgataccggagagcaggaaggcaattgcgcggggaactccggacagcgcgaccaggtcaaagaacaccagcttgaaggtgcccgcaaccgccaagccaacgccggtccaaagggcgccgggcgcgtcgagaagcttcctattaagcatcagtgctgcggcgatgaccatccacaggatagaaaccgtggcgtggccgatgaggaatccgagcatcatgccggcatttcctgcgatgaggcgaccgatgaaggttgtgatggtcacgatggaaattgcggacagcgtgagaagcgtcaagccgaccaaaatttgcagccacagtttgtgtccgtagaagctgcggcggacttggattgtggcggcaatgaacaccaagatcagcaatgcttggatgagcgcttgggtatcggtgagccacagtggagaaattgaaacgacattgcgcagtagcacgccggtcatcgccacggcggcaatcagccaagcgacccatgggacgacacctaattgacgctgcggtggaagcatccgcaaccacataaatagtgcagctccggcgatgaggaacaccatgacgagaagcgggttggtggggagatcgccgtagaacagctggacaaaagtttcagcaatcaacgcaaggccaacaacagcaatgaggcgagacatgcgttgattttcaatggacgcggtgtctgatgagcgcagcgcgaaaattccgagagctgccaccgcacacgctggtatcagggcaagccatggccagtcgactgcaatgaacatgctggtggtgatgaacacgatgagcaccggagaaacagcacccacccacgtggaaacagggttggtttcaaagctgcgccagtattcctccaacgcgatgtcgtggctgtcggtggcggtgatcttaaacggatcccacaatgtcaaggctacgagtaggactgcagtaattgtgccgacgattgttgctggccattccatggtttgccaggatgccgacaaaacaaactgcagaatgaccgcgaatgccgccatgctcgctcggatgatattcgtggagatgcggtacgacagcaacaatgccgcaacaatggagaaaattggccaccaggcatcggcggagagcgcgaagagtatcgcggagaatcctgaaacggcgatggctcccacaaatactgtgtggccttcggccgcggacttctcggttttggataggctccacaatcgaccaacgattaagaacccaatattgcctattaatgccaccagcgagcccaatccaggcggccaccattccaaaatgaagatgattgcactcgttgtggcaagaaacgcaatctgggaggtaaccgtcaacgcaacgagtgcttccacacgggttccgcgcttgcgcacataatgtgcggcgccaagaagcagcaccgccagcaggtacgcaccaatcacacgacccagcggaccaagccaaccgcgttgaatcgccaccgacaccagcaaaatcacgccggccacggtgatcacaccaccgccgatcgccacgccacgcatgatcttttcctccgacgtcatcggcggctttgccggacgagctggccggacggggtgcgggtacgcaggagcctgcactttttgcttctcgacgccaagtggccagccttcgctcgctggatccagggcgcgatgccgaacgaaacgtggaatacggttggtcccggaaacatccgccagtgcaggcgccgttgaggcggttgcatacaccagtggttggggctcaagctgagcctcgggtggggcagtgggcgctggggtgggagccgggtttgcgtcgataagcgacatctcttgggcatcaaggcgtgcaacgagatctttgatgtcattgctcgctgacgccatggcggtagccgatgccgacaatttctctaacgcggtgcgtagagccaatcggtcagaagagttcatgtccattacataagattatgttggtgtgaagaactaaacagcccgattattctagtgacgctaattcgttatactgtcgacccccgcggaagtcctctgaacagcgattttgtgtttagcgggggagggtgttagagtttataccactaccgcccgacatcaggttttcctggtgtgggtcgcaagaggagatcttcccacctaaggccgccaagtaaaattggttggatacaggtaaagcaagtagtgatgacacggactagtgcccgtgtataactcttgaaagtcagatctcccgttcatcctagatgatgaacgggtttttggtctgcataggggcaatcacctcaagtggttcggtacgtcaaattttcccgcactgctaacagaggagtccacatcagcgctgaagctcgcattaatgagcgcatccgagttcccgaagtccgccttgtcggacctaacggtgagcaagtaggcatcgtccgtatcgaagatgcccgcaagctcgcattcgacgcagacctagacctggtcgaggtcgcacccaacgccaaacctccagtctgcaagatcatggactacggaaagttcaagtacgaagcggcccaaaaggctcgtgagtcacgcaagaatcagcagcagaccgtggtcaaagagcaaaagcttcgtcccaagatcgatgatcatgattatgagacgaagaagaacaatgtgatccgattccttgaaaagggatcaaaggtcaaagtcacgatcatgttccgtggtcgtgagcaggctcgcccagagcttggctacaggctcctcgagcgactggcaaacgatgtcgtagattttggcatcgtggaaacccgcgcaaagcaggacggacgaaacatgacaatggttctcggtccggtgcgcaagggcaagaaataatcacgaatagggtttaaggacaactttcatgaagaacaagacccacaagggcaccgcaaagcgcgttaaggtgactggctccggcaagctcgttcgcgagcaggcaaaccgccgccaccttctcgagggcaagtcatctacccgcactcgtcgcctgaagggcatcgttgaggttgacaaggccgacaccaagcgcatgaagcgcctgctcggcaaggcttaagtttaaaaccttcgcctaaacccctccacctttcaagacaagatttaaggaagtaccaccgtggcacgtgtcaagcggtccgttaacgcaaagaagaagcgtcgcgaaattctgaagtccgcaaagggctaccgcggccagcgctcacgcctttaccgtaaggctaaggagcagtggctgcactccatgacttactcttaccgcgatcgtcgcgcccgtaagagcgagttccgtaagctgtggatccagcgtatcaacgctgctgcacgtatgaacggcatcacctacaaccgtctcatccagggccttcgccttgctgagatcgaggtcgaccgcaagatcctcgctgatctcgcagtcaacgactttgcaaccttctccgcaatctgcgaggctgcaaaggctgcacttcctgaggacgttaacgctccaaaggctgcttaagcttacaaacgaattgacctgtgtcctgtcaccttcacggtggcgggggacaggtctttttctatttttggggttggggagctgcgattagtttgcgtttaatccgtgcttgatcgtgtcgagagcaattttaaagtggctttcagcagcgttaataatgctagttggagttgcgggatcaaagacccgaagcaacgaaaaacgaaatgtgtcgggcttaagctgtttgagttttacgtttccgccatgtccattggtggcgtagctgttccagcgttggcgtatgttttctagtccttcagctttgccgacatagtggcggccagtacgggtatcggtaatgaggtaaatacctttgacagcaccaagagctgtgcgccacgaagcataggcaggttcacgcatcacttcttgaagaaatgggtagctcaggacaagattgtcgaaacctggaaacggaataggctccgcatcggcaatagtatccacggtgtatagggcagcagtagtgcccttaatccaccacttgcgtggtgaattccaacgaataacgagtctgcctgcaaggtcatccatgagttcaatctcagtaaggttgaagactctgcgtacgccatcattggtgacttcgccgtggttttccaccactttccatagtcgagcctgcgagccaccttctcggatgaacaccatccagaagcgtggcggattcagtgggaatctacgcggatcacttgactggctagctgtgtaggcgagaatctcttcgtctttagattcacgggtaataccattggaattggtgtcctcgtggatcgaaataaatacatgacgcattgctaacgcatcttcaggattgattcccgcagcctgcaaaattggcttcaagagcaatgtcatggtcgatctcacaattcattaatgaaggcgggtttggcctgtaggttgaactattaacaggccgtagatagttatttttccttgttgctaaagtacaccgagtcttatccatttggtgcgaaggattccgattcagtcactgcatagattcacatttgcgctggcgcacttcgccttgcgactagattggaaactatgtgccaatgatcaatccccgtgtccaccccaggagatatggttccaggagttactgcaccaacccatggggaggaatcatgagagtgaacagggaatttggctgggaagaagtcggcccaagccaagaaggggaacgattcacttttagtgatgaagcagtcagacacatggttgatatcaatgagcgattcaaggcgcttcaagccgagcatcctgttgtccagcggtttctggaacatgactcggaaaaagatcaggttttagatgagatctacaagtcattggcgtcggaggttatctacttttcgtcgcagtctgggttgatgatttcttttgattggatgggctgggaagaagcaaactactggctattttccgaaagatccaataaaggggagtcagtgaacatggagactgtaatggatgtggagactgcgagaaagttgataaccgcattggtccgttctgagtattttggctactacacaccaactggttttcttaaaaacggtaactttttgtttatttttgaccgcttaaccgggatgattgcacgcggtgaacgttgagccctaggggagtggtcggcacgcatgcgcgcgcgatagtacatagactgggagcaggcttccaaggaaatgaagctgagaaacaggttaattcacttaaacgtcaccttatttatgcattatgttggtttcagactcgaacaattcaattagaaaacactaatcggacatttaggtcacataacatttccgctcgtgtccacattaatttctgaacccgaggtggataagctacgtaaacgtgccaagagatcaaggcggacagaatggtggcttgccgccgcacttcttgccccaaacttgcttctcttggccatctttacgtatcggccactgttagataacttccggttgtcctttttcaactggaacatttcctcgcccacatcaaccttcattgggtttgataactacgttgagttcttcactcgtagtgacactctccaagttgttttaaacaccgtcatcttcacggcatgtgctgtgatcggatcgatggtgctcggtttgctcctggccatgttgttggatcagaagcttttcggccgtaactttgtgcgttccatggtgtttgccccgtttgtgatttccggtgctgccattggtgttgctttccagttcgtttttgaccctaattttggtttggttcaggacttgctgggacgcatcggcgttgattcgccacagttctaccaaaaccctaactgggcattgttcatggtgacgttcactttcgtgtggaagaacttgggctactcctttgttatctacctggctgcattgcaggggctaaacaaggatttgtctgaggccgcagcggtggatggcgcgagcgcgtggacacgtttttggaaggttactcttccgcagcttcgcccaaccacgttcttcctttctattactgtcacgctgaactcggttcaggtcttcgacatcattcacaccatgactcgtggtggccccttgggtaacggtacgaccaccttggtttaccaggtgtacaccgagactttcaccaactatcgcgcgggatatggtgcaacaatcgcaacgattttgttcctgttgctgctgattatcactgttatccaggttcgatacatggataaggagaacaagcagaaatgatctcgactgatagaaacgttttggtcaaaatcatgggctatgtcggcatggttcttgccatcttgttcattggccttccgctggtatttattgtgctgactagcttcaagcagcagtcagagatttacacccagccggtcacgtggttcccttcggaatttaatttcgataactatgcaaatgttttcgagcgggttccgttcctgaactacttccgcaactcgatcatcatcacggttattttgtgtctggtgaagattatcttgggtgtgatctctgcatatgcgttgtcgattttgcgcttcccgggtcgaaaccttgtgttcttgctggttatctccgcgctgatggtgccttccgaagtgactgttatttccaactatgcgttggtcagtcagcttggttggcgcgatacctaccagggcatcatcgttccgctagcgggtattgctttcggaacgttcctcatgcgtaaccacttcatgtctattccttctgagctcattgaagctgcgcgaatggatcactgtggacacttcaggttgctctggaaggttttgcttccaatctctatgcctacgttggtggcgttctccatgatcaccgtggtgaatgaatggaaccaatacctgtggcctttcctgatggcagaaaccgataattcagcaactctgcccattggtttgaccatgcttcaaaacaatgagggtgtctccaactggggacctgtcatggccgcaacgatcatgaccatgttgcctgtgcttgtgatgttcttggcactgcagcagtacatgatcaagggacttatctccggcgccgtcaagggctaaaaacttctcgctaaaaacttctcgctaaaggcttctcctagaagcttctccatgggttaacacaacccatatccctcccactacatatataaggactgaaaatggctcagatttctcgtcgtcacttcctggctgcagcaactgttgcaggcgcaggcgcaactttggcagcatgtgcgggtaccggtggaagcacttcttcctccagcgattctggttcagagagtgacaccaacaccatcgtttggtggtctaaccacccagcgaactccaaggacgttgagctggagctgatttcccgcttcgaggctgaaaacccagatctgaaggttcagctggttgatgctggagctaactacgctgaggtttcccagaagttcaatgccgctctttctggcggcgaccttcctgacctcgtggttctttctgacaccgagtggtttaacttcgccatcaacggcgcaaccgtgaacatcgatgaggttgcaaagcgcaacaacatcgacacctccacctacgttgactccctgttcaatgactactcacacgagggtggccactatggtttgcctttcgctcgctccactgtcctcttctactacaacaaggatctgtgggctaaggctggcctggaagatcgtggcccagagtcatgggaagagttctccgagtggggtccaaagctgcaggaagcgatggacagtggtttcgcacacggttggggagatgcaaccaactacctttcttggactttcgaaggcccaatgtggtccctcggcggcaactactctgaaggttgggagtcccgtctgactaccccagagaccatccgtgcagttgagtggctcaagtccaccgttgatgaaggtttcgcaaccgtctccaccgacgtcaccaacgagttcgcaaccggcctgatcggttcatgcatccagtccaccggtgatctgtcttcggttgccggcgctgcaagcttcgactggggcgtagcagcacttcctaacccaaccggcgagggcgcttgcccaaccggtggcgcaggcctgggaatcccatctggcatctctgagcagcgtcaggacaacgccctgaagttcatcgacttcctcaccaacgccgcgaacactggctactggtcccgcgagaccggttatgttccagttcgtaaggatgctgcatctgatccagatcacgcagcattcctcgaggagaaccctgcatacaacgttgcagtggagcagcttcctgatacccgttcccaggacaacttccgcgtgctgctgccaaacggtgaccgcaccatcggtgacgcactggagaagatctgcctgactggtgcagacatcgatgtcaccctggctgaggttgagaccaagctgaacaccatctacacccgcgacatcgaaccacttatttaatccgagcacttcagctacacctatttaaggaggctgtgacatggcgtcaatcgtctttgaaaacgtcacacgcaaatactctccgggcgcacgcccggccgtcgacaagcttaatttggaaatcgccgacggcgagttcctagttctcgttggaccctcaggctgtggaaagtccacttctttgcgcatgctggctggtcttgagcctatcgacgagggacgtctactcattgatggtaaagacgccacggaactgcgtccgcaggatcgtgacatcgctatggtcttccagagctacgcgctgtacccgaatatgactgttcgggacaacatgggctttgcgctgaagaatcagaaggtggctaaggctgagatcgaaaagcgtgttgctgaagcctcacgcattctgcagctggatccgtatcttgatcgtaagcctgcagctttgtctggtggtcagcgccagcgcgtggccatgggccgtgcaattgtgcgtgagccatcggtgttctgcatggatgagccactgtccaacctagatgcgaagctgcgtgtgtctacgcgtgcggagatctctggtttgcagcgtcgcatgggcgtgaccacggtgtatgtgactcacgatcaggtcgaggccatgaccatgggtgatcgcgtcgctgtgcttttgctcggtgtgctgcagcaagtagacaccccgcagaacctgtacgactacccagcaaatgcgttcgtcgccagcttcattggttccccttccatgaacttgattgagggcaccatccgtggcgataaggtcactttgggtactggaattcagatttcagttcctgatgaggtggcagcagaggttcgcaacaacccggatcgctttgagggtcgtccagtcattgttggtgctcgtcccgagcacatgtatttgaccacggcgaatgagagtggtgctgtattgggcgaagtcagccacattgatgagctcggcgcggattcaatggtctacgtattggcgtctggtgtgaagaacccgaatactgatcttttgggtgagggcattccagaggatatgcgcgtgaccgttgtcggtgctgaagagaccgataaggcccggctgggtattcgtgttgagcgccatcacggtctgaaggccggcgataaggtgcacgttgttgctgcaccgaaggatgttcacctcttcgacggtcttgatggccgtcgaatcggtgcaacggttctagctccagcccatacagtccaggctggtcactagattatttaccagtgcaactccccagcaggggagggcgcgaggaaacgagagggatcgctaacagtggcgtaatcaacgccagcttgttgtgcgatcccaaacgcattttcatcccgaattgtccagcagccaaccttgattcccttggtatgtagatcagcaattgacgccacgtttagtgctttccacgagggcaagatcgcgcccacattttttagcgggatgtaatcaagaatgcgcagatcatccatggacgcatcgcgcaagattcccacgcgagcttctggcagtcgatccacgatttccaccagtgctgcatcgatgaaactgatgaacagcaggcgctccaggtgctctgggtatttctgcaataatgctgcggctgctggaactgcaccggcagatttgatttccacttggatcggcaggctcgtctggagtagaacttcctccagggttggtacgggggatccgtcgataagcgttatctccttgatttgcgcggcgcttaagcgcgcaaccggggtgtcgcggtgcagggaatctggcgcggcaacacgcgctgcggtgcggtcgtggataacgatgacctgattgtcagcggtggcgtggatatccagctcaaaagcgtcagcgggcgcggcagcctggaaagcggtcatggtgttttcgaggtgcagatcttccgcaccgcgatgggcaacaatgtgcatattcttatacatccttttctgtgggctttttaaggatagggagcaaagttgaccgcacggttaactgttagtgttatgagcatggcattggactttaatgaggcgtttaccgaacgcaccccgcgcatcgtcaacgcagctaaactgcatcgcgccgcgcagcgcaaaaaagataagcgttttctagttgaaggcgaaaattccgttgaagcagctgtcgctaccggcgcagcaactgacctctttgtcactgaatccgctgcggagcgcttcgaggaaatcgtccgcaccgccggttacatgaatgtctacacccacgcgatcacggacaaggccgcgaagcatcttagcgacaccgtcaccaccacgggcatttttgcgctttgcgacgacgtcctgtggtcagtcggcaaggcgatcaccggccagccacgtctagtgagcgtgccggttgagacccgcgagcccggtaatgccggaaccttgattcgcgtatccgacgcggtcggcgccgacgccgtcgtcttcgctggtgaatcagtagatccacttggcgcaaaagctgtgcgctcctcagcgggatcgctgtttcacattccagtggcacgcaacaacaacatcgcagatgtcttggggcagcttcgttccaagggtctgcagatccttgcgacctcagccgatggggaagtagacctcgatgacgccgatgagctgctagccaagccaaccgcatggctttttggtaatgaagctcacggacttgatgagagcctgcttgctcaggctgatcaccgcgtgcgtattccgatccgcggccgcgcagaatcactcaatttggccacagcagcgtcaatttgtctgtacgaatcctccaaggcactattcgccggtgagtaaaccccaattcatgcccagcgggtatgatggcggggttagttgacttaacaataaacatgagggaagggctggactacacggtgtccgaaattcagttgaccgaagccagtttgaacgaggcggccgacgccgcgatcaaggctttcgacggtgcacaaaacctagatgaactcgcagcactacgccgcgatcacttgggtgatgccgcacctattccgcaggcacgacgctcattgggaactattcctaaagatcagcgcaaggatgcgggccgctttgtcaacatggcacttggtcgcgcagaaaagcactttgctcaggtcaaggttgttttggaagaaaagcgcaacgcagaagtcctagagcttgagcgcgttgacgtcaccgttccaaccacccgcgagcaggttggtgcgctgcaccccatcacgatcctcaacgagcagatcgcagacatcttcgtgggcatgggctgggaaatcgccgagggcccagaggtggaagcagaatacttcaacttcgacgcactgaacttcctgcctgatcacccagctcgtacactgcaggacaccttccacattgcgccggaaggctcccgccaggtgctgcgtacccacacctcaccagttcaggtgcgcaccatgctcaaccgtgaagttccgatctacatcgcatgccctggccgtgtgttccgtaccgacgaactcgatgcaacacacacccctgtgttccaccagatcgaaggccttgcagttgataagggtctgactatggctcacctgcgcggcaccttggatcacctggccaaggaactcttcggcccagagaccaagactcgtatgcgctccaactacttcccattcaccgagccttccgctgaggttgatgtgtggttccctaacaagaagggtggtgcaggctggatcgagtggggtggctgtggcatggtcaacccaaacgtgcttcgtgccgtgggtgttgacccagaggagtacaccggattcgcgttcggcatgggcattgaacgtaccctgcagttccgcaacggcctgagcgatatgcgcgacatggttgagggcgatattcgcttcaccctcccattcggcattcaggcataactcatcccgcacacgacttatatataggagcaaaattccaccatgttgattgcacaaaactgggtgacgggactgctgggccacgcaaacgaaggctggaaggtgccatcgtctgatttggactcaggttatgtccgcgtcggctttgaaaccgaaggctactggccaatccctgaaaccaccggaccactcgttttcggccgcgtggaaaccatcgaagagctcaccgagttcaagaagcccatccgccactgccacgtcaatgttggcgacgccaacggaaccggcgaactgcagtccatcgtttgtggcgcccgcaacttcaaggaaggcgacaccgttgtcgtgtcccttcctggcgctgtgctgcctggcgatttcgcgatctctgctcgtgaaacttacggacgcatgtctgcaggcatgatctgttctgcctctgagctgggtcttgctgataagcagaactccggcatcatcaccctggatccttcttacggcgagcctggcgaagacgcacgtcaagcactgggacttgaagataccgttttcgatgtcaacgtcaccccagaccgcggttacgcactgtctgctcgtggcctgacccgcgaactggcatcggctttcagcctgaccttcaccgaccctgcgatcgagccagctgtagcaggcattgaggtcaaggtcccagcagttgaaggttccttgattaacgtggagctgcgtgaagagaccaaggcaatccgtttcggtctgcgtaaagtctctggcattgatccagcagcagaatccccattctggatgcagcgtgaactcatgctctctggtcagcgaccagtcaacgccgccaccgacgtcaccaactacgtcatgttgctgctcggccagccgatgcatgctttcgacgcagccaaggttactggcgatcttgttgtccgcaacgcaactgcaggcgagaagttcgaaaccctcgatcacgtcaagcgcaccctcaatgaggaagacgttgtgatcaccgatgacaacggcattcagtctttggctggcgttatgggtggtctcacctccgagatctctgacaccaccaccgatgtctacttcgaggccgcaacctgggacaccatcaccgttgcgcgcacctcacgtcgccacaagttgagctccgaagcttctcgacgtttcgagcgtggcgttgaccctgcgatcgtggaaatcgccctcgatatcgcagcaacccttctcgtggagatcgcaggcggcaccgtcgatgcgggtcgcaccctcgttggtgatgtccctgccatgcaacccatcaccatgaaggtcactcgaccttccgagctcgcaggcgtggattattccgcagaaactgtgatcgctcgtctggaagaggtcggatgcaccgtcgctgtttccggcgacaccttggaagtaacccctccaacctggcgcggtgacctcaccatgtccgctgacctcgtggaagaagtactccgcctcgaaggtttggaagcaattccaaccatcatcccaaccgcaccagcaggccgtggactaaccgatgcacagaagcgccgccgcgccgttggccacgctttggcttacgctggctacgccgaaatcatcccaagcccattcatggacccagaggtcttcgatgtatggggactcgcagcagacgacgagcgccgcaagaccgtttccgttctcaacccacttgaggcagaacgcaacgtcctgagcacctccttgctgccctccatgctcgatgctgtcaagcgcaacgttgcacgtggacacaacgatttctccctgttcggcctgcagcaggtcgccttcgagcacggatccggcgtttccccaatgccatctgttgcttcacgccctgaagagtctgtcgtggcagaactggtggattcactgccaaaccagccactgcatgtcgcaaccgtgggcaccggcaacatcgagttcgaaggcccatggggcaagggccgcgcctacaccttcgccgacgcgattgaatccgcgcgcgcagtcgcccgcgctgctggcgtcaccttggagctggccaacgccgacgcgcttccttggcacccaggtcgttgcgccgcattgcttatcgacggtacccccgtcggttacgctggcgaacttcacccacagatcctggaaaaggccggtctaccagcacgcacctgtgcaatggaactggatctcagcgcactgccactggtagaaaacctcccagcgccagtcctgtcctccttcccagcactgcaccaagacatcgccctagttgtggatgagaccatcccggccgaagatgtccgcgcagttgtcgaagccggcgccggcgaactgatcgaaacggtcgagcttttcgacgtctaccgctccgaacagctcggcgagaacaagaaatccctcgcgttctccctgcgtttccgcgcaaccgaccgcaccctcaccgatgaggaagccaacgaagcacgacttcaggcagcagagctagcaaaggagaaattcaacgctgaaatgcgtggctagtttcacataggttctataggcgccctggtggttaatcccaccggggcgtcttttgctgtgctgtgaactgcgacaccgacttcacgtggtcgacttcagtgtgattttccggcttttcctcgtgaagtcgtgcggtgagaagttgagtacgtgaagtcgtgggatgtgaagtcgccccttaagttcgataccttgcgctcaattttgcatactcaatttcttaagggcaatttcaataggttcttgatgattttcctagcagtattgtaggtaagaaatcgcccccgagaacccgctgatgtgaaattgctgccgtgaaatcgaagtttcgggttgtggcggtgggggagctgaggaaacagttagtttttgcttaaacacccaaaatacagtaactggtgttactgttgtgactgaagttaattgattggcaggcaaatgcattgaaatcgtgatcgcctgttattgttttgtacgtcgaataacagtcccacaacagttccccaaaaggtgcgagcgggaaaaggagaagcaaacatggctcagcgaaaactggcctctgtgatcggtgcagcattggcagcatctgctgtactggttggattaatgacacccgcaacagcacaaagtagtggcagctcatcaacagacatcactcgagcactcacctcaagtggtggtgtggctgatagccgtgctcctgaaggtggcgcaaaggtcgttgttttcggtgactcccacacctctggcaccaatgctccattccgtaccgatgagcgtggctgcctcaagggtgcaaacaactgggcagatcagctgcagtctcagctgggacttggcgcgggagacctcattgatgtctcctgctccggtgcatcgatcaactctgatggattccacttctctgatgaagtccgccatgctgaagctcgtggcgcaatcggcccaaacaccaccgatatttttgttcagttgggcaagaatgatcagtggggcctttccaatgtgaaccttctgcagtctgttcagacctgcttgactgatgtgttcgctggttgtggcgatgctgcggttgctgctggcaagatgcaggatccaaatgcagttactgctgaaaactatgcagagcgcatgaagccagtcattgactacttgaagtactacgcaccaaacgcagagatcaccttggttggttaccaggaatacaccgctcgcagcggaagtcaggtatgtgttcgccttggtggaaccccactggtgaaaaatgatgcacctgcgctggtttcgttcatgaacaagttggacatggcgattgatggtgctgctggaatcctcggcgtcagccacgttgatctgcgtagcgcgactgaagggcacgacagctgctccaacgatccttgggtcaacggtgtctttgatgcacgtgcagaaatcgtcggcggtccgtggcacccatctgttaagggagactcggttactgcagggatcctgcgagatcgagtaaacgcctaaagatgacgtcgaaaagcattagcggcaagcgcccgaatctgccgtcgctcactggagcgcggtggctcgcggcgctcgctgtttattttttgcatgcgttggtgtttttgtcggtgtatccgttccagcagtcggaactgtttgccacaatccataaatttgtccccatgcagctgggttcagctggtgtaaccttcttctttatcttgtccggatttttgatctattggtcaaatagccagctcaagggcatgaagaatgtgctgtattactgcaagcgccgcatcaccaagatttatcccatgcacttgattgcgttggcgatgtttattgtggcgtcggcgaagttcacgactacaggcattacctgggtgctggattttgcgcgagtagagctgtggctgccgaatgcgctgctcatccacacgtggaatcctgattgggtgacgctgggtggattgaatgtaccatcgtggtcgctgggcgcggaaatgctgttctacctgacgttcccgctgtttattccgttagtgcgcaaagtgaagggcgtgggcaactggtgggcatttggcatcacctttgccgtgagcctggcgctgattacagtgattcacttttatgcggacggaccaaaggggattgagaacttctttgttcctcgcctgtgggacaccaatgtgtcaccggtcgcggaagttcacgccgatccagtgtggtttatgcaggaagaaattcccgtgctggaatcttactggctgtcttactacttcccgctgaccagactcatcgagttctacctcggtgtgtttggcgcgaagctggttgctgaaggcatgtttaaaaacaccaacatcaccatcccgctgatcgcactggctgtttcttttgttgctacttggtttgtgccactggcattcaagatgtctgtcatcatgtccctgccaatggcttttgttgtggcaacgcttgcggtgagagacattgaaggcaagagtggggaaatcgcctcgcctcgcgcagttttgttgggtaatatttcctttgccttctacatggtgcaattccccgtcatggtgtttgtgcagcgctatttcattgctggcaaagaatacggcttccttggctgggcattctatgcagtggtgtgtttcatcgtgtcggtcattctcgcgtgggtgctgtttaccttcgttgatgatcctttgatgaaggccacggcgcgcaagaaggggagtaggcgcttgaagcagtccaatattttggtccgtgacctgaaagttctcttcggcaaaagccccgaaaagccgttaaaagttgagactcgcgctgagaatctcacagaaaactccgaagctcccgctaaggtagctaccggaatcaaatcttagggaaggaaaacatatggctatttaccgtaagcttgcggcttccgctgcagcactggccctgtccgcatcactggtcgcttgtggcgactctgaggacaccaccgaagaaacctcaaccacctcttcttcgaccacttccagctcctccagcagctctagctccagcaccgcggctacttccgaggaatcttccgcagttgaagagccagcagtggaagctcctgtggaagaggctccagtcgaggcacctgttgagcaggcacctgtcgtggagcaagctccagttgagcaggctccggcaccggttcaggaagcacctgcaccagtcgagcaggctccagctccagttcaggaagcacctgcagctgacgcgccacctgcacttccaggtggtggcggcggacacgctggctactaaaaattcatgcttttacccacttgcagttttagctgtaggtgggtttttgcatgtctaacccgtcttttatgcacacccccgcaatgaatcaaaaatttatgcatgaataatttgcatgatcatgcataacgtgtatggtgtaactatgacaatcaaggttgcaatcgcaggagccagtggatatgccggcggagaaatccttcgtctccttttaggccatccagcttatgcatctggtgaactagaaatcggagcactcaccgcggcatcaaccgcaggcagcacgctcggtgaattgatgccacacattccgcagttggcggatcgtgttattcaagacaccacagctgaaactctagccggtcatgatgtcgtatttctaggacttccacacggattctctgcagaaattgcacttcagctcggaccagatgtcacagtgattgactgtgcagctgactttcgtctgcaaaatgctgcagattgggagaagttctacggctcagagcaccagggaacatggccttatggcattccagaaatgccaggacaccgcgaggctcttcgtggtgctaagcgtgtagcagtgccaggatgtttcccaaccggtgcaaccttggctcttcttcctgcggttcaagcgggacttatcgagccagatgtttccgtagtgtccatcaccggcgtatcaggtgcaggtaagaaagcatctgttgcactacttggctcggaaaccatgggttcactcaaggcgtacaacacctccggaaagcaccgccacaccccggaaattgcccagaacctcggcgaagtcagcgacaagccagtcaaggtgagcttcaccccagtgcttgcaccgttacctcgcggaattctcaccactgcaaccgcacctttgaaagaaggcgttaccgcagaacaggctcgcgcagtatatgaagagttctatgcacaggaaaccttcgtgcatgttcttccagaaggtgcacagccacaaacccaagcagttcttggctccaacatgtgccacgtgcaggtagaaattgatgaggaagcaggcaaagtccttgttacctccgcaatcgataacctcaccaagggaactgccggcgccgctgttcagtgcatgaacttaagcgttggttttgatgaggcagcaggcctgccacaggtcggcgtcgcaccttaaagtagcgccttaaagcggcgcttcaaaccaagcgccctaaccagcaaacacaacaaacacatctaattcagtaggagttccacatggcagaaaaaggcattaccgcgccgaaaggcttcgttgcttctgcaacgaccgcgggtattaaagcttctggcaatcctgacatggcgttggtggttaaccagggtccagagttttccgcagcggccgtgtttacacgtaaccgagttttcgcagcgcctgtgaaggtgagccgagagaacgttgctgatggccagatcagggctgttttgtacaacgctggtaatgctaatgcgtgtaatggtctgcagggtgagaaggatgctcgtgagtctgtttctcatctagctcaaaatttgggcttggaggattccgatattggtgtgtgttccactggtcttattggtgagttgcttccgatggataagctcaatgcaggtattgatcagctgaccgctgagggcgctttgggtgacaatggtgcagctgctgccaaggcgatcatgaccactgacacggtggataaggaaaccgtcgtgtttgctgatggttggactgtcggcggaatgggcaagggcgtgggcatgatggcgccgtctcttgccaccatgctggtctgcttgaccactgatgcatccgttactcaggaaatggctcagatcgcgctggctaatgctacggccgttacgtttgacaccctggatattgatggatcaacctccaccaatgacaccgtgttcctgctggcatctggcgctagcggaatcaccccaactcaggatgaactcaacgatgcggtgtacgcagcttgttctgatatcgcagcgaagcttcaggctgatgcagagggtgtgaccaagcgcgttgctgtgacagtggtgggaaccaccaacaacgagcaggcgattaatgcggctcgcactgttgctcgtgacaatttgttcaagtgcgcaatgtttggatctgatccaaactggggtcgcgtgttggctgcagtcggcatggctgatgctgatatggaaccagagaagatttctgtgttcttcaatggtcaagcagtatgccttgattccactggcgctcctggtgctcgtgaggtggatctttccggcgctgacattgatgtccgaattgatttgggcaccagtggggaaggccaggcaacagttcgaaccactgacctgagcttctcctacgtggagatcaactccgcgtacagctcttaaaaagaaacagcactccaactaacaagcagggaaaagggcacaggcatgaatgacttgatcaaagatttaggctctgaggtgcgcgcaaatgtcctcgctgaggcgttgccatggttgcagcacttccgcgacaagattgttgtcgtgaaatatggcggaaacgccatggtggatgatgatctcaaggctgcttttgctgccgacatggtcttcttgcgcaccgtgggcgcaaaaccagtggtggtgcacggtggtggacctcagatttctgagatgctaaaccgtgtgggtctccagggcgagttcaagggtggtttccgtgtgaccactcctgaggtcatggacattgtgcgcatggtgctctttggtcaggtcggtcgcgatttagttggtttgatcaactctcatggcccttacgctgtgggaacctccggtgaggatgccggcctgtttaccgcgcagaagcgcatggtcaacatcgatggcgtacccactgatattggtttggtcggagacatcattaatgtcgatgcctcttccttgatggatatcatcgaggccggtcgcattcctgtggtctctacgattgctccaggcgaagacggccagatttacaacattaacgccgataccgcagcaggtgctttggctgcagcgattggtgcagaacgcctgctggttctcaccaatgtggaaggtctgtacaccgattggcctgataagagctcactggtgtccaagatcaaggccaccgagctggaggccattcttccgggacttgattccggcatgattccaaagatggagtcttgcttgaacgcggtgcgtgggggagtaagcgctgctcatgtcattgacggccgcatcgcgcactcggtgttgctggagcttttgaccatgggtggaattggcacgatggtgctgccggatgtttttgatcgggagaattatcctgaaggcaccgtttttagaaaagacgacaaggatggggaactgtaaatgagcacgctggaaacttggccacaggtcattattaatacgtacggcaccccaccagttgagctggtgtccggcaagggcgcaaccgtcactgatgaccagggcaatgtctacatcgacttgctcgcgggcatcgcagtcaacgcgttgggccacgcccacccggcgatcatcgaggcggtcaccaaccagatcggccaacttggtcacgtctcaaacttgttcgcatccaggcccgtcgtcgaggtcgccgaggagctcatcaagcgtttttcgcttgacgacgccaccctcgccgcgcaaacccgggttttcttctgcaactcgggcgccgaagcaaacgaggctgctttcaagattgcacgcttgactggtcgttcccggattctggctgcagttcatggtttccacggccgcaccatgggttccctcgcgctgactggccagccagacaagcgtgaagcgttcctgccaatgccaagcggtgtggagttctacccttacggcgacaccgattacttgcgcaaaatggtagaaaccaacccaacggatgtggctgctatcttcctcgagccaatccagggtgaaacgggcgttgttccagcacctgaaggattcctcaaggcagtgcgcgagctgtgcgatgagtacggcatcttgatgatcaccgatgaagtccagactggcgttggccgtaccggcgatttctttgcacatcagcacgatggcgttgttcccgatgtggtgaccatggccaagggacttggcggcggtcttcccatcggtgcttgtttggccactggccgtgcagctgaattgatgaccccaggcaagcacggcaccactttcggtggcaacccagttgcttgtgcagctgccaaggcagtgctgtctgttgtcgatgacgctttctgcgcagaagttgcccgcaagggcgagctgttcaaggaacttcttgccaaggttgacggcgttgtagacgtccgtggcaggggcttgatgttgggcgtggtgctggagcgcgacgtcgcaaagcaagctgttcttgatggttttaagcacggcgttattttgaatgcaccggcggacaacattatccgtttgaccccgccgctggtgatcaccgacgaagaaatcgcagacgcagtcaaggctattgccgagacaatcgcataaaggactcaaacttatgacttcacaaccacaggttcgccattttctggctgatgatgatctcacccctgcagagcaggcagaggttttgaccctagccgcaaagctcaaggcagcgccgttttcggagcgtccactcgagggaccaaagtccgttgcagttctttttgataagacttcaactcgtactcgcttctccttcgacgcgggcatcgctcatttgggtggacacgccatcgtcgtggattccggtagctcacagatgggtaagggcgagtccctgcaggacaccgcagctgtattgtcccgctacgtggaagcaattgtgtggcgcacctacgcacacagcaatttccacgccatggcggagacgtccactgtgccgctggtgaactccttgtccgatgatctgcacccatgccagattctggctgatctgcagactatcgtggaaaacctcagccctgaagaaggcccagcaggccttaagggtaagaaggctgtgtacctgggcgatggcgacaacaacatggccaactcctacatgattggctttgccaccgcgggcatggatatttccatcatcgctcctgaagggttccagcctcgtgcggaattcgtggagcgcgcggaaaagcgtggccaggaaaccggcgcgaaggttgttgtcaccgacagcctcgacgaggttgccggcgccgatgttgtcatcaccgatacctgggtatccatgggtatggaaaacgacggcatcgatcgcaccacacctttcgttccttaccaggtcaacgatgaggtcatggcgaaagctaacgacggcgccatcttcctgcactgccttcctgcctaccgtggcaaagaagtggcagcctccgtgattgatggaccagcgtccaaagttttcgatgaagcagaaaaccgcctccacgctcagaaagcactgctggtgtggctgctggccaaccagccgaggtaagacatgtcccttggctcaaccccgtcaacaccggaaaacttaaatcccgtgactcgcactgcacgccaagctctcattttgcagattttggacaaacaaaaagtcaccagccaggtacaactgtctgaattgctgctggatgaaggcatcgatatcacccaggccaccttgtcccgagatctcgatgaactcggtgcacgcaaggttcgccccgatgggggacgcgcctactacgcggtcggcccagtagatagcatcgcccgcgaagatctccggggtccgtcggagaagctgcgccgcatgcttgatgaactgctggtttctacagatcattccggcaacatcgcgatgctgcgcaccccgccgggagctgcccagtacctggcaagtttcatcgatagggtggggctgaaagaagtcgttggcaccatcgctggtgatgacaccgttttcgttctcgcccgtgatccgctcacaggtaaagaactaggtgaattactcagcgggcgcaccacttaaagcgcccctagttcaaggcttgttaatcgcttgttaatgcaggcaggtaaggtataacccgagtgttttttcgaggaataccaaccctttcaacacaataattttctttaaacatccttgctgtccaccacggctggcaaggaacttaaaatgaaggagcacacctcatgactaaccgcatcgttcttgcatactccggcggtctggacaccactgtggcaattccatacctgaagaagatgattgatggtgaagtcatcgcagtttccctcgacctgggccagggtggagagaacatggacaacgttcgccagcgtgcattggatgccggtgcagctgagtccatcgttgttgatgcaaaggatgagttcgctgaggagtactgcctgccaaccatcaaggcaaacggcatgtacatgaagcagtacccactggtttctgcaatctcccgcccactgatcgtcaagcacctcgttgaggctggcaagcagttcaacggtacccacgttgcacacggctgcactggtaagggcaacgaccaggttcgtttcgaggtcggcttcatggacaccgatccaaacctggagatcattgcacctgctcgtgacttcgcatggacccgcgacaaggctatcgccttcgccgaggagaacaacgttccaatcgagcagtccgtgaagtccccattctccatcgaccagaacgtctggggccgcgctattgagaccggttacctggaagatctgtggaatgctccaaccaaggacatctacgcatacaccgaggatccagctctgggtaacgctccagatgaggtcatcatctccttcgagggtggcaagccagtctccatcgatggccgtccagtctccgtactgcaggctattgaagagctgaaccgtcgtgcaggcgcacagggcgttggccgccttgacatggttgaggaccgtctcgtgggcatcaagtcccgcgaaatctacgaagcaccaggcgcaatcgcactgattaaggctcacgaggctttggaagatgtcaccatcgagcgcgaactggctcgctacaagcgcggcgttgacgcacgttgggctgaggaagtatacgacggcctgtggttcggacctctgaagcgctccctggacgcgttcattgattccacccaggagcacgtcaccggcgatatccgcatggttctgcacgcaggttccatcaccatcaatggtcgtcgttccagccactccctgtacgacttcaacctggctacctacgacaccggcgacaccttcgaccagaccctggctaagggctttgtccagctgcacggtctgtcctccaagatcgctaacaagcgcgatcgcgaagctggcaacaactaagccaccttttcaagcatccagactagaacttcaagtatttagaaagtagaagaacaccacatggaacagcacggaaccaatgaaggtgcgctgtggggcggccgcttctccggtggaccctccgaggccatgttcgccttgagtgtctccactcatttcgactgggttttggccccttatgatgtgttggcctccaaggcacacgccaaggttttgcaccaagcagatctactttctgatgaagatctagccaccatgctggctgggcttgatcagctgggcaaggatgtcgccgacggaaccttcggtccgctgccttctgatgaggatgtgcacggcgcgatggaacgcggtctgattgaccgcgttggtcctgaggtgggcggccgtctgcgcgctggtcgttcccgcaacgaccaggtggcaaccctgttccgcatgtgggtccgcgacgcagtgcgcgacatcgcgctgggaacaaccgagcttgtcgacgccctcagcgcccaagctaaggcacatgcaggcgcgatcatgccaggcaagacccacttccaggcagctcagccggtccttctggcacaccagctgctggcacacgcacagcctttgctgcgcgatattgatcgtatccgtgacctggacaagcgtcttgcggtgtctccttacggttccggcgcacttgctggttcctctttgaagctcaaccctgaagcaatcgctgaagaactcggctttgattccgcagcagataactccattgatgccaccagctcccgcgatttcgcatctgaaaccgccttcgtgctggcgcagcttgcagtggatatgtcccgcttggctgaagaaatcatcgcatggtgcaccccagaatttggttacatcaccttgtctgattcctggtccacaggcagctcaatcatgccgcagaagaagaaccctgacgtggcagagctgacccgtggcaagtctggtcgcttgatcggtaacctcaccggtctgctggctaccctgaaggcacagcctttagcgtacaaccgcgacctgcaggaagataaggaaccaatcgtagattccgtggcgcagctcaacctgctgctccctgcaatgactggtttggtttccaccttgaccttcaacaccgagcgcatgcgtgaacttgcaccagcaggtttcacccttgccaccgacttggctgagtggatggtgcgccagggcgttccattccgtgaggcacacgaagcatccggcgcttgcgtgcggatcgcggagtccaggggagtggaccttatcgatctcactgatgaagaactcagtggcgttgatgcacgtctgaccccagaggtacgggaagtgctcaccattgatggtgcagtggcttcccgtgcaacgcgcggtggaaccgcgggcgtgcgggttgcggagcaacgcgcacgtgtcgatgccgcaagtaccgctcacgcggagtgggcacgtgcgggggtacgtcgataagcattagtttatggcctgtgctgctttccgattgcgggagttgcacaggccatttattatcaattcatgaatggttcccctgattactcaagaaaatctcgaggcaggggattttccgtatttttaggcatcatcctgctggtcatcgcggtattagcggtcttggtgggccgcggaaccatcgccatgccaaagctcttcggatcaagtaacttgaccgaggtcagagcagtaattggctcggaaaagaaggaattcttcgaagatccagaagtcgttgaagccttcgccgaccacggctttgaagttaacgtggacaccgcaggatctcgtcggatcgccactgatgtggacttgagcccgtacgatttcgcgttcccatcctctgcaccagctgcgcagaagatctccgaagccaacaccacgacgggccgattcaccccattctattcgcctatggcggtagcaacattcggaaccatcaccgacatgttggaaaccaaggggatcgtgagcaatgtaggcggcaccgacaccatcgatttgggcgcgttgttgaatgaaacccaagccggaacccgctggagcgaacttagccccaactatcagtccaaccgcgtcgtgcagatttctaccaccgatgtgcgcacctctaactcggcggccatgtacctatcaatgatgtcctgggtgaaaaatggcggaaaaacggtgagcagcactgcggaagccgatgccatcatcccagagcttagccaactgttcgtgggccagggctataccgaaagcacctccgccggcccgtttgatgaatacctctcccaaggaatgggttctaaaccaatggtgatgatctacgaagcccagttcctcgcggaacaaaacaaggaaaactcacggatttccggcgatatggaactagtgtatccaagccccaccgtgtacagcacgcatacggtggttagcttgagtgacgtcggcgcggagatcggcgaactcctagaaaccgacgaaaccctgcagcagttggcagtcaaacacggttttaggccaaagaactccgcaatgatcgccgatgctggcatgaccgaccgcatgcccaacaacctcaatgtcattgatccgccggactatgacttcctagaacgactcattgatggcgtgggcgcatcgtacagtgccaccccagcagaagaggacacagatctatgaaaaatcttgtaaaaggtacagcgctgggcttgagcttggtgcttctggcaggttgttcaactgtttcggattctatcgatagcctcggcgggggcctgggtggttcctctgagactttgaagattgtggccgccacagagctggaagatctgcagcccgcgatcgagcaagcctccgacgacttgggttttgatattgaactgagctttccaggcggcacactcagcaacagccaagccctcatggatggcgcttttgaccaggactatgatgccacctggtttgccaccaaccgttacgtcgatctgatcggcgcttccaacaagctgggggagaccaccaaaatcgcgacctctcccgtggcgttcggtgtgaaaacttccatggcccaggagctcggctgggatcagcgccagccaacctgggaagagctgggccaggcctcgcagacccaagatttcaccttcggtatgaccgatccggccacttccaactccggattttccgcgctcgttgccatggccacggcatatgctgataccggccaggccttaacaaccaacgacatccccgcgatcgccgagccgatgtccacatccctttccggccaaaccatcacctccggttcctctggctggctcaaagacactttcctggaacagcctgaccgcgcgaatgcgatcatcaactacgagtccgtcctgcacaccatgatcagcgaagacggcgccgatatcaccgtcgtggtgcccgccgatggcgtggtcagcgccgattacccgctctctacgatcacgggctccgaccagggcgagcatgtagcagagctggccggctggttcgctgagcaccccgacgctttaacagatacttatcgacgtccgaccaccgcgaacgcaacgctcccagcggagcttagctcgcagaccatcatcgaagctcccttcccagggagcaagacggtcaccgacgcgcttatcgacgcctacaccaatcaattccgcgtcccaggcgaaaccacctttgtgctcgacgtttccggatccatgctgggccagcgcatcaccttgctcaaagacaccatgtcagacctgatcagcggcggcgcgaccactgaccttgccaacgtgtccctgcgcgaccgcgaaaaagtatcgatcattcctttcagcttcgggccacacgaagtaatcagcgaaaccctcggtgcggtgggcagcccaagccgcaccgatctgcagcagcgcgttgaagccttgcaagcagacggcggaaccggaatttacgacgcagtgctcgccgcctacgcagagtccgctggtggcgactacatcccatccatcgtgctcatgaccgacggcgaactcaccgcaggacgaacctacgatcaattcctcaccgaatggaacgcgcttcctagcaatatccgatcaattccagtgtttgtcatcctttacggtgaagccaatgttgcggatatggaacaattggcagcaacaaccggcggtgagacctttgacgccatcaacggtgacctagacgaagcatttaaggagattcgtgcctaccaataatggaggatccttctttttctcccgcaagaatctcgcgggtatcgctattgcaacgctgattatcgcgctgcacttagtgatcggactcggagcattttggcctgttgtcgccatcgccggatacggcgctgcggtggcacttacacctaaaaaccctccgaagaaggaactccctccggttcaggcaactcccgaattagatagcccgggtctgcttgcagccaggtctcaagaactcgtgagaactatgtatagccacggtgctgcagcaccagtgatcgaagcgattaagaggctagacagctcactgcaattggtcattggtaactggacaagcctgaccaattttcccgagcaccaagtcaccattcgctcaattatcaaccagtacatcccaggcattatcgacgcttacctgaagatccccacccgcaacgatcctcgggcagtcgaagacctcattgaatccttcgacctcctgaactccgagacgatgaagatcttcaatgcgatccaagaacaaggccttaataaccttgaagatcacggtcgcgcactgcgcatgcaatttggtcaactgccagaagaattccgggaatagccactcaatgcagttaagtttttcctgcccggtaggatggtccgtatgagtcttgatccacagcttcttgaagtcctggcctgcccaaaggacaagggcccacttcgatatctggagagcgaacagctcttggtcaacgaacgcctcaacctggcctatcgcattgacgacggaattccggtgcttctcatcgacgaagccaccgagtggacccccaacaactagaagtacatcaaggacatttttaacaccatgaacatcattgacgaactctcctggcgcggactcatcaaccagtccaccgaccttgaggcccttcgcgaggaagcttcaacccccatcaccttgtactgcggattcgacccaaccggtccatccctccacgcaggacacctcgttccactgctcatgctgcgccgtttccagcaagcaggacacaacccaatcgtgctcgcaggtggcgcaaccggcatgatcggcgacccccgcgatgtcggcgagcgcaccatgaactccgcagacaccgtctctgattgggcagaacgcatctccggtcagctcagccgcttcgttgatttcgacggcgagcacgcagcccgtctggtcaacaacgccgagtggaccaacgaaatgtccgtagtgaccttcctccgtgatgtaggaaagcacttctccctcaacaccatgctcgcccgcgacaccgtcaagcgtcgcctcgagtccgacggcatttcctacaccgagttctcctacatgctgctacaggccaacgactacgttgaactgaacaagcgcttcggctgcaccctgcaggtaggtggcggtgaccagtggggcaacatcgtttctggcgttgacctcaaccgtcgcgtcaacggcacctctgtccacgcagtgaccgtacctttggttaccgattccgacggcaagaagttcggcaagtccaccggcggcggaagcctctggttggatccggaaatgaccagcccatacgcttggtaccagtacttcatcaacgcatccgacgctgacgtgatccgttacctccgctggttcaccttcctcacccaggaagaacttgctgagttggaagttgaagttgcagagcgcccattcaagcgcgaagcacagcgtcgtcttgcacgcgaaatgaccaacttggttcacggaaccgaagcaaccgaagcagtcgagcttgctgctcaagcactgttcggccgcgcagaactccgcgacctagacgaaaaaactctcgctgcatccgtttctgaaactgcagttgcagaaatcaaggcaggggagccacgcaccatcatagatctgctcgtggccagcggacttgctgattccaagggcgcagcaaagcgtgcagtcaaggaaggcggtgcgtacgtaaacaacgaacgcatcgaatcggatgattgggagcctttcgctgaagatcttcttcacggttcatggctagtactgcgccgtggcaagaagaacttcgcaggagttcagatcctcggctaataatcgctgaaatgattgcggtttttcatttgtctgacttctggaaaaccaaaaggaggggtgagcaccaaattctggtgctcacccctccttttagcaattaatccctcgtattaatccctcgtggtgttcacgatgtagagatcgcagttagctgctgccgcgacattacgggagatgcttccgagaatgcgttgcaagccctgggccttcttgttccccacaacaattgcatcagcattgaggtgctccgcctgctgaaccaaaacttcagcaggctgtccctcaacagcaatcgccttgacctggagtgttggccaagagttgcgcaaaatagcagccacagattctgcagcttcctgagcagctgcagcctgaccatcggccagacgctggtaagcatcggaagtcttaactgccatgtttccgctcttagcggtctgcatcgctacaacagagctgatgctgtacgcagaaaatacgtaaagttctgcgtcaaagctggccgcgagctcggcagccttctctgctgcggcaagcgcagtctggcttgaatcaacgccagtaatgattgtcttcatggtgcggtatctaccttccaggttgaataaggatggaaactgagtttcagctcacatcttactattgtccgaatgtctagtcatagtcttcggttcaaaaatgctctcagaagaatacttctagtttctcgagcgtttgactggaagcctcttttttgggggttggcgacgcgtatatcccagtaatgatgggacggattccaaccttggtattgatcatcccatatcttttgagcgcatatgggcgattgatatgatcatttaaatgattgcatcggcataacgctgtcgacgcctggatgagtaggattcgaaatctttggggcatgttcaatctaaatttggccgacttttgctgtctcatgatcatgcgcgtgcaggggtctgcgttgaaatcgtgtttaacctgcaggtttgttcttgcgtgaggggctgtgtagattaattcgagtcgccaggacagcgcaggaacttctacacggaagggaaagcacatcaaggtgacacggagattaattcgaagttgacttcaaattttgaatgaactacgatgaatcttcagctgctaggggagcaagaacaaacattgtatcttgttttcagagtgtgcgtatgttgtttgagaactcaatagtgtgccatttattatttttgtcactaccacaaccacttaggttgtggtgggtcatgccgggtggtggatcgccaatattatccatcactgtaaacaataatcttattgttggcatgattttgtgggtctgcttgttccccgtcaagggattcaggcccacgttgaagacacgatgatccttatgtgggttgtggtgtttttttagaatcattattttttgataatgccagtaacaccccattgtccaactgtcacctttgtgtggttggtgggggtgttgttgtttttgtcaggtgttgggcttttcacggcctaaacaatctatttattgttttttgtggagagtttgatcctggctcaggacgaacgctggcggcgtgcttaacacatgcaagtcgaacgctgaaaccggagcttgctttggtggatgagtggcgaacgggtgagtaacacgtgggtgatctgccctacactttgggataagcctgggaaactgggtctaataccgaatattcacaccaccgtaggggtggtgtggaaagctttatgcggtgtgggatgagcctgcggcctatcagcttgttggtggggtaatggcctaccaaggcgtcgacgggtagccggcctgagagggtgtacggccacattgggactgagacacggcccagactcctacgggaggcagcagtggggaatattgcacaatgggcgcaagcctgatgcagcgacgccgcgtgggggatgaaggccttcgggttgtaaactcctttcgctagggacgaagccttatggtgacggtacctggagaagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggtcttccacgacttctgtgccgcagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatggaccggatcggcgtagagatacgttttcccttgtggtcggttcacaggtggtgcatggttgtcgtcagctcgtgtcgtgagatgttgggttaagtcccgcaacgagcgcaacccttgtcttatgttgccagcacattatggtgggtactcatgagagactgccggggttaactcggaggaaggtggggatgacgtcaaatcatcatgccccttatgtccagggcttcacacatgctacaatggtcggtacagcgagttgccacaccgtgaggtggagctaatctcttaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaaccttttaggggggagctgtcgaaggtgggatcggcgattgggacgaagtcgtaacaaggtagccgtaccggaaggtgcggctggatcacctcctttctaaggagctttattaacccacatcagactgtgtctggttggtgggttgttggtgttggaacccgtatgtggttgccatcaacatatttttaatcgggtggagatgacccctagggtgacaacaacaagaccacatggtcttgaacaatgagtggcatgctgttgggtgtctggaatgacatcgcaagcatcacctttttggtggtgtgtgtgggttgtttctaacatcgagcatcgtcaacacgggtagagaatgttgtgttctttggttgtggtgggggtggtgtgttgtgtgagaactgtatagtggacgcgagcatctttatttttttgttttttgttgtgtgataccgaacgcgctcgcactttgtgtgtgggttatagtattttgtttgttgttttgtagggcacacggtggatgccttggcatatcaagccgatgaaggacgtgagaggctgcgttatgcctcggggagttgccaactaagcgttgatccgaggatgtccgaatggggaaacccagccgcagtgatgtgtggttacctgccagtgaatgtatagctggtgtggaggtttacacggggaagtgaaacatctcagtacccgtaggagaagaaaacaattgtgattccgttagtagtggcgagcgaacgtggatgatggctaaaacttatgtgtgtgatacccggcaggggttgcatgtaggtggttgtggggcaataacatccatattctgccggatgtgggcatgtgctgcgtggttagtggaagtggtgtggaaacacctgccgtagaaggtgagagtcctgtacacgaagatcatggtggtgtgtgtggttgttgataccccgagtagcagcgggctcgtggaatctgctgtgaattagccgggaccacccggtaagcctgaatacttgatatgaccgatagcggattagtaccgtgagggaatggtgaaaagtaccccgggaggggagtgaaatagtacctgaaaccgtgtgctgtcaatccgtcagagcatcctttgtggtgtgatggcgtgccttttgaagaatgagcctgcgagtcagcggcatgtcgcgaggttaacccgtgtggggtagccgtagggaaaccgaatcctaacgagggtgttttagtggcatgtcttggacccgaagcggagtgatctacccatggccagtgtgaagcagctgtaagaggttgtggaggcgcgaacccacttaggttgaaaactgaggggatgagttgtgggtaggggtgaaaggccaatcaaactccgtgatagctggttctccccgaaatgcatttaggtgcagcgtcgtgtgtttcttgccggaggtagagctactggatggtttagcgggaccaacatcttagcgacatcagccaaactccgaatgccggtaagtgagagcacggcagtgagactgcgggggataagcttcgtagtcgagagggaaacagcccagatcgccggctaaggcccctaagggtgtgctaagtggaaaaggaggtggggtcgcgaagacagccaggaggttggcttagaagcagccatccttgaaagagtgcgtaatagctcactggtcgagtgattccgcgccgacaatgtagtggggcttaagtacaccgccgaagccgcggcaatgatctttataggattgttgggtaggggagcgtcgtgcatgcgttgaagctttggggtgaccttgggtggagtgtgtgcgagtgagaatgcaggcatgagtaacgaatgatgcgtgagaaacgtatccgccggatgactaagggttcctgggtcaagttaatcttcccagggtgagtcggggcctaaggcgaggccgacaggcgtagtcgatggataacgggttgatattcccgtacccgagtatgagcgaccatggtgaatcagtgatactaaccacccataagcacccgcgaaaaggctttgcttttttgtggtgtgtggttgcgtgggacctgatctggtagtagctaagtgatggggtgacgcagggaggtagctcagccacttattggattgtggtgtaagcgtgtggcacgcagtgttggtaaatccgcactgtttttgtgtgaggcgtgatgcggagcccgtaaagggtgaagtgggtgatcctgtgctgtcgagaaaagcctctagcgatgttgatattcggcccgtaccctaaaccgacacaggtagtcaggtagagaatactaaggcgttcgggtgaactgtggttaaggaactcggcaaaatgcccccgtaacttcgggagaaggggggccacggcgtgtgaacaacttttcgttgggagcgtgttgtggtcgcagagaatagagggaagcgactgtttactaaaaacacaggtccgtgcgaagacgtttaagttgatgtatacggactgacgcctgcccggtgctggaaggttaagaggaccggttaggaaaacttgttttttcgaagctgagaatttaagccccagtaaacggcggtggtaactataaccatcctaaggtagcgaaattccttgtcgggtaagttccgacctgcacgaatggcgtaacgacttccctgctgtctcaaccacaggcccggtgaaattgcagtacgagtaaagatgctcgttacgcgcggcaggacgaaaagaccccgggaccttcactatagcttggtattggtgtttgattcggtttgtgtaggataggtgggagacttcgatcatatgacgctagttgtgtgtgagtcgttggtgaaataccactctgatcggattggatgtcttaaccttggcccatgatctgggttggggacagtgcctggtgggtagtttaactggggcggttgcctcctaaaatgtaacggaggcgcccaaaggtttcctcagcttggttggtaatcaggtggtgagtgtaagtgcacaagggagcttgactgtgacactgacaggtggagcagggacgaaagtcgggactagtgatccggcacctacttgtggttgtggtgtcgctcaacggataaaaggtaccccggggataacaggctgatcttccccaagagtccatatcgacgggatggtttggcacctcgatgtcggctcgtcgcatcctggggctggagtaggtcccaagggttgggctgttcgcccattaaagcggcacgcgagctgggtttagaacgtcgtgagacagttcggtctctatccgccgcgcgcgttgaaacttgaaggaaggctgtccctagtacgagaggaccgggacggacgtacctctggtgtgccagttgttccgccaggagcagggctggttggctacgtacgggagggataaccgctgaaagcatctaagcgggaagcctgtttcgagatgaggtttcttttgaggttccctagagattatggggttgataggccagatctggaagcactgtgaggtgtggaggtgactggtactaatttaccgataacaacaaaccacttatggtttggtgtaacgcaacgtaacgaaaacagaacagtatgtgttcgcgtccattatgcagtgtctgacacagcacaaccaacctgttggttggtgtggtgtgtggttgtgtcggtggtgatagtagcagggaaacgcccggtccctttccgaacccggaagctaagcctggttacgctgatggtactgcactcgggagggtgtgggagagtaggttaccgccgaccaaaaacttaaaagtgaaatagaaagagtgtgattcaatggtagaggtatttcatttcctcccattggatcacactctttttgtcgttctataataaagtctttacccggttctcaacatcaaggaacaacatggctgataacttcgaccgctctcgtgacaacgatcgctcaagcgaccgcactcctcgtggagaccgcggcgatcgcggtggctaccgaaactcccgcggcaacgatgaccgcggaaactaccgtcaaaaccgagatggtgaatcacgagatcgcggcggataccgcggtgaccgtcgcgacaaccgctcaggtgaatatcgtcaacgtgacgataggcgtgacgatcgtagggacaaccgaagcgatgaccgccgcggtggttaccgctccgatcgcaactttgacgatcgcaacagcaacatgcgtgatgatcgtcgcggcggcgaccgttcatacagccgtaatgatcgctccgatcgtggctatcgtagcaatgaccgctacgaccgtaatgatcgtcgcgatgacaacagggacaccaggggtggcgatcgcggagaccgtcgctacgacaggcgcgatgaccgacgtgatgatcgtcgcgatgatcgtcgtggcggacagggccaggggcgtccaggtggagatcgtcgacatgcgaaccgtgcaggtgcaggtcgcgatcagcagcgtgattcgctgcatccacagcgcgctggtttccgtgaagagcgcttgaacactcgtctcaatgagcctgatttgccgggcgatattgatatcaaggacttggatcctttggtcctgcaggatttgaaggttttgtctaaggacaacgcagatgccgtcgcaaagcatatgatcatggctgcgacctggctggccgacgatcctcaattggcactgcgccacgcccgtgctgcgaaggatcgcgcgggacgcgtgtccgtcgtgcgtgagacgaacggcattgctgcttaccatgctggtgagtggaaggaagctctttcggagcttcgtgctgcgcgccgcatgtcgggtggtcctggtttgattgctgtgatggctgactgtgagcgtggcttgggtcgtcctgagaaggcgattgagctggctcgagaagaggatttgagctctttggatcaggataacctgatcgagttagcgattgttgttgctggagcacgccatgatttgggtcagcatgactctgcgattgtggaattgcagaaggttaatccaagcttgaagagcaccggtttcacccattctcgtttgtcttacgcttacgccgatgcgcttgttttggctggtcgtggcgatgaagcacgtgagtggttccagcacgctgccaccttggatgaggacggctacctcgatgcagaggagcgtatcgagcagctcgataatgggaacaactagactattggtctatgagtgtaatcacggaatatgacagccttcttcttgatctagatggaaccgtctacgagggcggccgagccattgagcacgtagtttctgcgctctctggcgccggcctacccgtcatgtatgtcaccaataatgcctcccgtgctccggaggtggtggctgcgcaactccgtgagattggccttgccgacaccactgcggacaatgtgatgacatctgctcaagctgcctgcaagatggcggcggagaagattcccgctggatccaaggtgtatgttttgggttcagaatccttccgcgagctagctactgaagctggttttgtggtggttgattcggctgatgataaacctgtggctgtgcttcacggccacaaccctgagaccggttgggctcagttgagcgaggctgcgctgtcaattaatgctggcgcgcagtattttgcatcaaatttggattccacccttcccatggaacgcggtcgtcacattggcaacggttccatggtggctgccgtggtcaacgcgactggcgtaaagcctctttccgcaggtaagccaggccccgcgatgttctatgcgggggctaaaactcttaattcttcaaagcctttggctgtcggcgatcgtctcgatactgatattgcaggcggaaacgctgcaggcatggacacattccaggtcctgaccggcgtcagcggctactacgatttggtgcgcgccattccagagcagcgccccacctatatcgccacctcgatgcaggatctctacagcgatccgggcgagctcaagccaggtgcccagggcggtttttcagcgcttatcgacggcgacaccctggtcatttccggcggcgatgccggcgcaactccggttgcagcactccgcactgcgttggatgtggcctgggcggccacagagccagtcaccgaggtacgcgctgattcagaggtagctgctactgcattgcagagctggtggtaaacggtgaattcaccaaagcctcatgatcctcgtgcagctcatgtgaccaacccggaagaaattgcgggaaaagtcaatgaggttttaagccgcgaagcagagacactgcgagatgaagccctcaaccttgaggaagcccaccgcatcctcaacgacgcattgtcttaaacactattttttaaccactcacgaaagaagaacacctccagatggttgcacgcagaagactggacgcagaacttgttcgtcgaaagatcgcacgatcaagggaacacgcggttgaaatgatccgcggtcggcgcgtctttgttgcaggaatgcttgctttaaagcccgcaacagtcgtggaaccagaggtgtctattcgtgtggaagaagatgctagtgaagattgggcatcccgcggtgcgcacaagcttcttggtgcgctggaatcttttgagcccttggggctcaaggtcaagggccgtcgcgtgctagatgccggcgcttcgacaggcggatttacggacgtgttgctacgtcgagaagcgtctgaagtagtggcagtagacgtgggctacggacagcttatttggcgcctgcaaaacgacgaccgcgtgcgcgtggtggaccgcaccaacatcagatacatgacgctggaagacaccggcggagaatgcgacatgatggtgggcgatctctcatttatttcgcttaaactcacgttgccggcgatcgccaaggtcctaagcgacggcgctgatctattacccatggtcaagccacaatttgaagtcggaaaagaccgattgggcagtggcggcgtggtgcgctcaccagagttgcgcgcagaagttaccgcggatgtcgcgaaatttgcggccactttgggcctgagcttgaagcatgttgttgcatccccgctgcccggcccgtcaggcaacgtagaatacttcctgtggctggttaaagatggtggcgcttcaatgccggatgaccagcaattgtcggcaatgattgacacggctgtaaaggaaggtccgcaataatgactgcacccacgaacgctggggaactcaggcgagttttgctggttccacacaccgggcgttcttccaatattgaatccgccatcttggcagccaagctgctcgacgatgctggaatcgatgtgagggtgctgatcaatgatgcagatgatccaattgcagagcactccgttttaggccgtttcacccatgtcaggcacgctgcagacgccgctgacggcgcagaactagttctggtgctgggtggagatggcaccttcctccgcgcagcagatatggcccacgctgttgatttgcctgttctgggcatcaacctaggccatgtgggattcttggctgaatgggagtctgactcacttgaagaggcactcaaacgtgtgatcgaccgcgattaccgtattgaagatcgcatgaccttaactgtcgttgtcctagacggcggtggagaagaaatcggccgaggctgggctctcaatgaggtcagtattgaaaacttaaaccgcaggggagtgctcgatgcaaccctcgaggtagatgcacgaccagttgcttcctttggttgcgatggcgtgctgatttccaccccaaccggctccaccgcttatgcattttccgccggtggtcctgtactgtggccagaactcgatgccatcttggtggttcctaataacgcccacgcgctgtttaccaaaccgctggttgtgagcccaaaatccaccgtagctgtggaatccaattcagatacttcagcagcgatggccgtcatggatggtttccgtcccattcctatgcctccaggatcccgtgttgaggtcaccaggggtgagcgtcccgtgcgttgggtgaggcttgattcttcaccgtttaccgaccgacttgtgagcaaattaaggctccccgttaccggttggcggggtccgcaaaaacaggcggaaaataaagatcccaggtcagcggggtaattcgaaaaccattcgaacaattttcgaggatttagaaaaaacgttcgcataaattgttagaactgatgtacactttgaggcatgctcgtagacattgctattgagaacctcggagttattccagcggcctcagctgagttcagctcaggtttaacagtgctcaccggtgagaccggcgccggaaagaccatggtagtgacaggtttacgcctgttatccggcggtcgcgccgacgcttcacgcgtgcgcacaggatcccctcaagctgttgtggaggggcgctttgttacgcaaggcgtgccctgcgacattgtcgaacgtgcaaccggaatcgtttcgaacgccggaggtgccgcagatgaaaatggagagtttttagctgtccgttccgtcggcgccaacggccgttcaaaagctcatctcggtggtcgctccgtacctgcggcaacgctgtccgagttctctgatgagctgttgaccatccacggtcaaaatgaccaactccggttgctctccccagaacgccaactagaggcgcttgatcgttttgatccagagctggcccaactgcgcaaaaactacaacgccaagtacctcacttggaagtccttggataaagatctgcagaagcgcctgagtagtaggcgagagctggctcaagaagtcgatcgcctgcaattcgcgattaatgagatcgaggaagtctcgccacagccaggcgaagacgccgaactggttgagcagatccgcaggctccaggacgtggacaccctgcgggagcaagctgcaaccgcattggctgcgattgatggtgccggctctctcagcgacgccatgggtggttccggcggctttgatgaatcccaggagtcagcctctgaccagctcggccaggcggagtccgcgctggcaggcagtgatgactcaaagctgaaagatattgccgttcagcttgcggaaatcaccagccagctcagccaagtgtccatggaattgggcgggttcctctctgatctccccgcagacccccaagcactcgatgacatgctcacccgccaacagcaattgaaactgctcacgcgtaaatacgctgcagatattgacggcgtgattgagtggcagcggaaagcccaaatccgcctagacagcattgacatttcctccgaagcgcttgacaagctgaaagaagacgcgaaaaaggcgcaggcctccatgatgcgtgccgctaagaagctttcagctgtccgtgcaaaggcagcaaccaagttggggacaactgtcaccgaggagcttcagggcctggccatgcaaaaagcccgctttgaggttgctttgacctccattgaggcgtgcgccagcggtatcgaccaggtggaattccagctcgcagcaaatgcctttgcacagcctcgtccacttgcatcctctgcgtctggtggtgaactttcccgcgttatgttggcgctcgaggtgatcttggctgctggaaccacgggcaccaccttggtgttcgacgaggttgatgcaggtgtgggcggacgcgcagcggtggaaatcggtcgccgcctggcccgccttgccaccaaaaaccaagtcatcgtggtcacccatctcccacaggtcgctgcttacgccgacacgcacctgcacgttgccaagaatgtaggagaagcctccgtgacctcaggagtggagtcactgaccttcgaccgacgcgtggaagagctctcccgcatgctcgctggcctcgacgacaccgccaccggccgagcccacgcaacggagctgctcgagcgtgcacagcgtgaaaaggaagatattaacgaggagcgagtagaaccacttctcgccgccagtgcataagagttttcttggaattttttaggcgcgcctccaccaaaggttgagactttggttccacaatgggctgcatgagtctgttcaaccgcaaagccgacctgcccggcctgcaaggtgccacccgaatctgcaccccgcagggcaaagggctaaagcgcctgtccgaaggcgatctcgcaatcattgatgcaccagatctatccaggaccttcgcccaacgattgctagcagcaaaacccgccgcagtcctcaacgtttcccggttcaccaccggatcggtgcccaactttggaccgcaaatgcttatcgacggcggcatccagctcgtggaaggctttggccaggagctgctcgacggcaccaaagacggtaagaaaggtcgcctgacagaagatggacagctcttctacggcgaacgactgatctctaacggcagtgttctcagtggacctgcggctgaaaatgcatttgcagacgcccagcaatcactgctggaccgcatggaagcctatttcggcaacaccattcagttcattcactcagaagcaccgctcctgatcgatggcctcggcattcccgataccggaaatgccattgaaggccgcaaagttctcattgcctcaccaggggataaccaccgcagcaggctcaaagaactccgcagcttcatccgcgaatacgatccagtactcatcggtgtcgatggggcagcagacaccttggtggaattggggtacaagcccgcgctgatcgtcggcaatcccactggtatcggcgcagatgcgctgcgcagtggcgccaacgtaattttgccagctgatccagacggccacgctgttggtctggagcgcatccaggatcttggcatcggtgcgatgaccttcccatcctcagtaaattcctccacggatctggcgctcctgcttgcggatttccacaacccgcagatgatcgtcaacgtcggcggtcctgtcacccttgatggtgtttttgaaaaccgcgaagattccgatcccgcggcgcttttgacgcgcgccaagctaggcaccaagcttgtcgacggatccgtcatcgcaagtctttacacagtgcgcagctccagcaaccttggatggatgtgggcactgttagccattttggtggttcttgcagtcgtgattgttatcgctggcaccgcaggatcaggctcttttaccgacaacctcattgacacctggaacagcttcgcgctgacagtccagggttggttcaaataggaaggcaacatggctaaacgacgtggaagaggcgccgcaaccttcgccgcactgggatttggtgcagcagccggcattgcctttggaacttatgtgcttgcacccaaccttcctgaaaacattgacccaaatgcaccaacatcagctgaattagtcgaggcagagaccttggctgaggttaatgcggtgcaggccgatcaagcagacagcatcattgaccacatcgtggaagacgtggtggctggcacactgaccgatcgccccgtactggtgatgcgcaccgctgacgctgaagaatcagacgttgccgatgtgtcatggctgttgcagcaagcaggagctattaatgctggatccattacacttgaggagaatttcttctcccaagacggcgcggaccagctgaaatcaatcgtggcaaatacgttgcctgcaggcgctcagctttctgaaacccaactggatccaggaactcacgctggcgaggcacttggtgccgctttgctgctcaaccctgaaactggtgaaccactagccagcactgcagagcgcggactattgctcaacgtgctgcgcgacaacggttacatctcgtacgaagacggcaccattttgccaggccaggtcatcgtgatgattactggcgatagcgacggctcaggtgatggtgccttcgctgcagaaacacaatcgctgtttgctcgcgcacttgacgcccaaggatcaggcgtggtggttgcaggacgtattcacactgctgctgatactggagttattggacggcttcgtgccaaccctgatgctgcagaaaacgtctctacaattgattccgtgaatcgtacttggggcaagatggctaccgtgctatcagttcgtgaggaactagccggtaggtctggagcgtttggttccgctgcctccgcagacgcggcaagtccgtctctcgatggaactgcagcagcgccagcgcagtaggttttccaagcctttaaaacggagtgtctaggcaaatggatgctccgttttcttttaccgcgaatcatctgttgatctatagatagataccagaaaaagggtctctgaactggcattatttttaaccccaattgctgtgttatgctggggttccgtaggtttgaaaagtcggaaacttctccgagctttccctgcggttttttgtttcccctttaggcgaatccacgtcagttttgggcagacaattaaagcggagaaagccacggaggggaccgtggccacgtgccggcaatttgaacacaccgaacgtttaagttttccgcaccgcctgactcgaaaagatcttttttaaagagctgttcgatgtttaggttcaaccaggaaggtcgtctcagacatcatgacctctagtcgaaaagtccgtcccaccaaacacattttcgtcaccggtggagttgtttcctcactcggcaaaggcctgaccgcagcaagccttggtcaattgctgattgcacggggactgtcggtgaccatgcagaagctggatccatacctcaatgttgatccgggcaccatgaatccttttgaacacggtgaagtctttgtcaccgaagacggggcagaaacagacctggatttgggccactacgagcgtttcctcgatcgcaacctggggctcaacgccaatgtcaccaccggcaaggtgtattccactgtgatcgccaaggagcgcaggggagagtacctgggtaaaactgtgcaggtcatcccacacatcactgatgagatcaaagctcgtattttgagcatgggcgaaccagatgctcatggtaacgccccagacgtggtgatctctgaggtcggtggcaccgtcggtgacattgaatcccagccattccttgaagcagctcgccaggtacgccatgaaattggtcgtgaaaactgcttcttcatccactgttctttggtgccatacttggctacctcaggtgagctgaagaccaaacccacccagcattctgtcgcagagctgcgcggcatcggtattttgccggatgctctcgtgcttcgttgcgatcgggaggtccctcaaggtctgaaagataagatcgcgatgatgtgcgatgttgattatgaaggcgttgtatcttgccctgattccagttctatttacaacattccagatgtcctctaccgcgagcacctggacaccttcattattcgtcgcctgggccttccgttccgtgatgttgactggagcacctggcacgatctgctggaacgggtgaacaacccacgccatgagctcaccgtcggcatcgtgggcaagtacattgatcttcccgatgcttatctctcagtggtggaagctgttcgcgctgcaggctacgccaattggacgcgcaccaatatcaagtggattacctcagatgattgcgaaaccccatctggcgccatgaaagcgctcagcggtttggatgccatcgtggttcccggaggtttcggtatccgaggtatcgaaggcaaaatcggtgcgattacgtttgcacgtgagcacaagatcccgcttcttggcctatgccttggcctgcagtgcaccgtcatcgaggcagcacgccaggcaggactggagcaggcatcatccactgagtttgacccagctgcaacgcagccagtgatcgccaccatggaagagcagaaagctgctgtgtcgggtgaagctgatctgggtggcaccatgcgtcttggcgcatatcctgcaaccctggaggaaggctccttagtagcggaactgtatggcacaacggaagtctccgagcgccaccgtcaccgctatgaggtcaataatgcctaccgcgcccagattgctgaaggttcagatttggtcttctccggaacctcacctgatggacatttggtggagttcgtggagtaccccaaagaggtgcatccttatctggtggcaacccaggcgcaccctgagtacaaatctcgtccaacccatgctcatccactgttttacggcctggtgaagaccgctttggagctgcgtgtccacccttagatctacaatgtgatcatggtttcgaagatgcacattcccggtacccatgagttcacggtgacagatactgaactgttgttagagtccccaattttgggcgttcgtcgagattcattgatcatgccgggtggttccactgcccgccgtgaagtggttgaacactttggggcggtcgcagtggttgcctttgatggtgaaaacattgcgatggtcaagcagtaccgtcgcagcgtgggggattccttgtgggagctgcctgcaggtttgttggatattgctgatgaggatgaactcacgggcgcgcagcgcgagctcatggaggaggctggtttggaggccagtgagtggtccgtgctcactgatttgattacctcgcctggtttctgcgatgaagcggtgcgtgtctttctagcccgaggcctcacaaaggttgagcgcccgaaggttatgggcgatgaagaagcggacatgattaaccagtgggttccgctacatgaggcagtgggaatggtgtttagtggccagttggttaactccattgccattgcgggtgtcatggctgctgatgctgtgattgcgggtcgtgcgtctgcgcgtgccgtcaccgcgccgtttacctatcgccctacggcgttggcgcagcgtcgaaaagcgcacggcattgttcctgacatgaaaaaactatgaaggctcgcgttttagcgaaaacatggctgacacatttggccgtggagcgtggcttgtcggcaaatacgctgagtaattatcggcgcgatgtggaacgctattgcgactggctcgaggcagctgggctggatgatattcgtgatatcaccaccgcgcatgtggaaagttatgtcaaagacctgcgccgcgggattgatggacaacaagcgttgtctgcgtcctcggcaggtcgcgcgctcatcgtcgcgcgcgggttgcacaagtttgcattgatggagggcgaggtggctgcggacgttgcggctgatgtgtcgccaccggccatgggccggcatttacctgacacgctcagcatcaacgaggtagccctgcttatcgacgcgatcccacattcagatatcgccactcccgttgatctccgtgaccgagcgctggtggaattactttatggaactggcgcgcgtatctctgaggcgattgggctggcagttgatgatgtgtcggaaatgcctgaagttcttcgcatcacgggcaaaggttccaaacaacggatcgtgccttttggttcgatggcacaacaagcggtccgggaatatttggtcagagccagacccgcgttgagtaaggggaaaagccatgcgctttttctcaaccaacgcggcggtccgctatctcggcaatctgcgtgggcagtgctgaagaaaacggttgagcgcgcaggtttagataaagatatttctccccacaccctgcggcacagctttgccacccatctcctcgaaggtggcgccgatgtccgtgtggtgcaggaactcctgggtcattcttctgtgacgaccactcagatttacacgcacatcacagccgatagcttgcgggaagtgtggcgcggggctcatcctcgtgcgtgaaagcccttgcgaattcttaagatttcaactcgatgtgcctccaatgagccgtatcgcggagtagctgtcgatcatgcgttaccatgatcactgcagccgcggtcgtgtccagccactctgtaagtgcggaaaccaagtgcatagacagatggttcgaaggttcatcgagaagcaacagttcaggattgccagctaacgacatggccaaatctagtcttctgcgttgaccaattgagaattcctgtagggcaaatcggctctcctcaacacttaaaagtccccacttaactgcgtgatctcgtgctattgatggcacctcgccgacaagtgattcttggccgagaaccccagttcgggcatggtttgcaaccgaaccacttgccggagtcaaaaccccagacaagacttcgatgagcgttgatttgccagcgccgttgtcaccagtgatcactattttgtcacctgataccactgaatgtgagcctggcagacgcaagcggtggggtacaaaaaggtccgaaaagtccaccatgggtttatctggtcgcactttcaaggtaggcagaagcaatggggccggagccgggggaacgtccaacgctttgctatccaacgcatcctgtgctcgctttaaggcctgcaccactccgggagcccgagatgcgcgagtgtgttttcccgttccttttggaggtttccacgaagaattcacccgctggcgtgcgtgctctagatcctcctgcaattgctgttgcacagtttgtgcagcggcataatcctgcctccaagtttcaagaagcgcactcctttggcgtcgataagaatcaaaaccctcatgatagatccgtggtaggccgtctggggttgaatcaatatcgatgatgaaatccgcgacatctttgatcagtgcttgatcatgagaaacaacaagtaccacacctttgtgggaggttatggcttcggtgagatagttaagcgcgccccggtcaagatgattggtgggttcatcgagaagcaaaatatcagcatcgccaccgatgaggcaggccagccgtacccgatacctttgcccgatcgatagctcactgagtgcacgggatctatcggtgatcgcgccaaagctgcgcagagctttttctaatcgatgttcagcgttccatgcgtcaagcacttcagcggcatcaagggcttgttgatatccatcaagtgcgtgcgcagtgtttgtctcaagtagagctccagctctctcaagctcttcgagagcattctttgaatcacgaattgcctcatcacagatctctccgacggacagatcacctgcaggcatgtgttgatgagcaattgctaccgtgccatgagtgagaatctcacctgcagatggcgggaattctcgagccagtgctcgcagaagtgtggttttacctcgaccattctcaccaacaatcactgcgcactgtccagaagaaacagtgatattgagcttcgtaattaacggggttgaggtgtatgacagggaaaggtcctgtaaccgaatatgggttttagccattaaaaaattcctttaaaagtgctagaaagtcgccctgcgaccagtcgtggcaggggaaaatcaacgtgcagagacggcactgggaggcatgtggcctgcagtgcgaactgtgcagcagcaacatttaaaggaaatacaaatgcattccgcttactttaataaagtggcaaagataaagcaatgacggtaggcaacgctcaatttgcagagctggtcaagttaaaaaacttgactcactattagagtttgcatgaaacggcgtgtggggcaacagaatgagttagacatctatatcctgaatgtattgtggtcgcggagactaatgacagtgcgataatttcaggactgttagtcgagagctgtaaagtcaaggctatatacttctcaagtcgcgccgaaatttgttaaatgactataaaaggcagtcctagtcaaggaagaaggtttgactgtgagtgatgcagggaagaaggactcttccaaggtggagatcggactgaccggtcgacccctgcgcgagttgcctgagccatctcctttggaaaaacatggcccagcaacgatcattgccatggcgaatcaaaaaggtggcgttggtaaaaccacgtccaccatcaacctcggagcatgccttgcagaggcgggacgtaaagtcctgctcgttgacttggatccgcaaggtgcgttgactgctggtttgggaatccactacgacgacgtggatatcaccgtgtatgacctcatggtggacaacaattccaccattgatcaggcgatccaccacactggtcttcctgatctggatgtcgttcctgcaaatattgacttgtccgctgcagaaattcagctggtcaatgaagttggtcgtgaacaaacacttgccagggcgctgcgtcctgtcatgaaggactacgacttcatcatccttgattgtcagccatcacttggtcttttgacggtgaacgctttggcgtgcgcgcacggggttatcatcccgatggagtgcgagtacttctcactgcgtggcctcgcattgctcacagacaccgtggaaaaagttgccgatcggttgaacttcgatctggaaatcctcggcatcttggtcactatgtttgaccgacgcacctctcacgccagggaagtgatgtcacgagttgttgaggttttcgatgagaaagtgttcgatacggtaatcacccgaaccgtcaggttccccgaaacctctgttgccggtgagccgatcatcacatgggcaccaacatcacaaggtgcggagcagtaccgttccttggcgcgtgaagttatcagccgcgtcaacgactaggttgtttttctaaaaaccacgcctccttgtgcgggcctgtcagtaactgttatcgcaggttcatgcgttaaggtgtggaagaccatgacaaaagtagcggagctggaccaagagtggtccgaagtagatgacgcggaattagacgcgcaaagcgctggcacttctgatagttccagcacagacgacttcgctgacgcagaaaacacttctgaaaatctgggacccatcggcccagaaccactccctgaaccagatggggatgttccggcatcgggtttccaagtgcagctcgataattttgaaggtccttttgaccttctcctgcagctgattaccaagaagaaacttgatgtcactgaagttgccttggcccaggtgaccgacgagtttattgcttacacccgaaaactgggcgaaaccagcgatttggatgagaccacagagttcttagtggtggccgcaacgctgttggatcttaaaacagctcgcctgctcccgcgtggtgaagtcgacgatgaagatgatctcgaattgctcgaaataaaggatctccttttcgccaggttgttgcagtatcgcgcttacaagcaagttgcggaaatgtttgcgcaatggcagcgagatgctcgacgcaggtacccgcgcgctgtctcattagaaactcagtttgccaacctcttgccgcccgtttccttgggtcattccttaaaaagtttcagcgagttggctgctgtggtgtttcgtccgaaacccccagagacggtgaaaacagatcacgtgcaccaagttgcggtgtcagttccagagcaagcgggcaggattcttaacacgttgaaacttgccggaattgatcattatttgagctttcagctgctcacacgtgattgtaccgcgtcaatggaagtgattggccgcttccttgccttgctggaattgtataaggcacgcgctattgaaaccttgcaagaagagccactcggcgagcttaaagtttcgtggactggcattgatgtcgatccagcagtcgtcgcggcgagtgactgggagtaatcagtttttcttaaggaaacgttgctgaattagttttagtgacctaagctacaagagctggtttgctgaaaaatggatgacctcgcagtttaactgcgttgtgtcatctacggcatggaaaggctcccacagcatctgttttggagagggcggatggtgtgggagctttttgtagcatctcaccccatgaaggggtgagattttctggtctatggtcgttgcttgagcatttcaagaatttcatccgatagcggacggtcagaataaattctcacatcaggctcgttggggtcatcttccgttccgactcgtcggccttcccatacgggggtgagtcccagtttttccaaaatacggaatgaggcagggtggttggtagtcaccctggccgtgagtgggaggctgtcgtcgatacgcttggtggccagtgttgcggcgttggagatttccgtggcgtatccattgccccataggtcggggcggaggcggtacttgaggtcccatacttttccgtcgatgagttcaacgccaccaacgccaacgaattccgatgggcggtcacggaggtaaacaccccaggggccaaggtctttcttgccccagctttcattggtgcgcttgatgatgtcgcgcgtgacacgcacgttggtgtgacgcgcctgggggcggtgttcccagattcgagaatcagagtaaatctggtgggcctcgtcttcgagctcaacagtgagcggtacgaggatcagtctgtcggtgcgtgtaatcgtagccatgaagaaatgttagatcatgagatgtcttatatgtgatggttctcacgactgaaatcattttgtgacctaacttgtattttttttgacagcttgattgacggacgatgggttaaagtgcacaggttgagccctattgagggtgggagagtgctactatctgcggttttgtgaattaaatgctgtgaactaccgcgaactcctcccattcaagtggtgttaagcactaagatggcaggttatgacttctcttaaagtaacttcgtccgcagatgcaaccaataacaatgatgcccattttcctgaaggtccagtggtaaccgttgactggttgtcacacaaccttgaccgggatgatgtcatcgtgttgtgtgccacaatggaggatgatgaaattgcacgtcaagcgggaattccgggggcatttctcgctgacttggaaggagatttctcagatccacattccgagcttccacacaccgcgccaccaaatttggtgggtttgctagaaagctacggcattagcaccgattccacggtggttgtttatgatctgcacggcctcatggttgcaccgcgggtgtggtggcttctccgtgttgctggattaagcagcattggcgtgcttgatggcggattgccagcctgggttgatgctggccttccaacggaaccgctgtcgctacctacaagtggtggaaggatcagcgcagaaccacagccagatttactcgttggtgcctccggcgttgaacgggcgatcgcgcgctcaagcaaggcagtgattgatgctcgtaatgcgagccgattcgctggcgttgaagaagagccccgtccaggccttcgaaaagggtcgatccctggaagcgtcaacattcccttcactgacatttctgatgagcatggttttgtccggccagcagaagaactgaaggaattgatcttcagccgcacaaatggagcgcagtcgttggtctttagctgtggctccggagtcacggcatgtgttgatgcctacgctgcagttatcgcaggttatgacgacgttgtagtgtatgaaggctcttgggcggagtggggcaacccggcaaaccaaaagccgattgcttaacgcccgctatgataaccactcatgaatgatttcgatccagcattgatttccgcgatgagccttatccctcagacgaggtctcggatggaatcaatcttgttggtggtcgataccccagtttcagcacgcacgctggctggggtgttgggcattgacgtgcctgcaacagaggcaattttgaaggaaatggcctttgagctttctgaacggggcagcggcattgatctgcgggaaacggcagaaggatggcgctattacacccgcccggaaaatgcggacatcgtcgagcaattcctcctcgatggaaaccaaaccagactgtcccgtgcagcattggaaacactcgcggtggtggcatatcggcagccggtcacacgctcccagatttcagcagtgcgcggagtaaatgtcgacggcgtcatgagaaccttgcagcttcgaggcctagtcaaagaagtcgatgtggacgaatcaacgggcgcacaccgctatggcacaacggaattgctgcttgagctgttgggtattgattctttggataaattaccagatctagcaccgcttttgccggatgttgactccattgatgaagacttctaaagcatcagttaaagccccgactattaaaatctcctaaaataggctagaattcacgggattcaatttcatacgttttctctcaagattaaggacacttacgtgaccccacccgctcgccgagatggcacaccggacaagaagcagagcaatcgctctggcggataccggtcttcagttcgtggctacaagccaggatcatcccgcccaaacacacgccagcagcctcagaagaaggatgagattcttctctccaacgctaagcctgccaagaagcaaaacgtaaaatccgacgacgattggtcgatgggtttcttaaaccgcaatgactctgacggagttcgcctgcagaaggtgcttgcccaagcaggtgtggcatcacgtcgacacgcagaaatcctgattgatcagggccgtgtggaggtcaacgatcgtatcgtgaccacccagggcgtgcgcgtggatccaaacaacgatgtcatccgtgttgacggcgtccgcatccacatcaacgaggacctcgagtacttcgtgctcaacaagcctcgtggcatgcactccaccatgagcgatgaacttggtcgcccatgcgtgggtgatctggtcagtgagaagactgcatctggacagcgtctgttccacgtcggtcgcctcgacgcggacaccgaaggtttgctgctgctcaccaacgatggtgagttggctaaccgcctcatgcaccctaagtacgaagtgtccaagacttaccttgctaccgttcgcggtgaagcaaccaataagctagtcagcgctcttcgtgatggcgtggagttggaagatggccctgccaaggctgactttgcgcagattatcgacgtattccagggcaagtccttgttgcgcatcgaaatccacgaaggccgcaagcacattgtgcgacgcctcttcgatgagctcggtttcccagtcgagcgcctcgtgcgcaccaagctgcacaccgttcagcttggtgatcagaagccaggttcccttcgtgcactgaactcctctgagctgaccagcttatacaaggtggtccaactgtgacggaaatttccaacatgcctgccggtggcctcatcgtagccatcgacgggccgtctggcaccggaaaatccaccacatcccgcgcgctcgcaacccgtctctcggccaagtacctagatactggtgcgatgtaccgcgtcgcaacgcttcatgtgcttaaccaggggattgaccctgcagatagcgcagccgtgatcgctgcaaccgctgtattgccgttgtcgatttctgacgatcccgcctccactgaggtgttgctcgcgggcgtcgatgtgcaaaaggacatccgcggaccagaagtcacccaaaatgtctccgcagtgtccgcgatccctgaggttcgtgaaaacttggtggcgttgcagcgcgcactcgccgccaaagcacatcgctgcgtcgtcgaaggcagagacatcggaacggcagtgcttgtcgacgcgcccatcaaggcgtttctcaccgcctcagcggaagtccgcgcccagcgacgctttgaccaagacaccgcagcaggtcgcgacgtagatttcgacgctgtgctggcagatgttgttcgccgcgatgaactagattccacccgtgccgcctcaccgctgaaaccagcagatgatgcacacatcgtggacacctctgatatgaccatggatcaagtacttgatcacctcatccacctagtggaagcctccgctgaaaggagcaaccagtgactgataaacacaccatgcctggtgaagaggacgacaccgtattcgtctaccacacccacaaaggcgaaatggacgtcgaaggtgcgtttgctgacgaagaagaactagcaccacacggcggttgggcttccgcagatttcgacccagcagaattcggctacgaagactctgacgatgacttcgatgcagaggactttgacgaaacagagttctccaaccctgatttcggcgaagactactctgatgaagactgggaagaaatcgagaccgcattcggattcgacccaagccaccttgaagaagctctctgcacggtcgctatcgtcggacgcccaaatgttggtaaatcaaccttggtgaaccgctttattggacgtcgagaagcagtcgtggaagatttccccggcgtaacccgtgaccgcatctcctacatctctgactggggtggacaccgtttctgggttcaggacacaggcggatgggatcctaacgtcaagggcatccacgcatcgatcgcacagcaagcagaagttgctatgagcactgccgatgtcatcgtattcgtcgtggacaccaaggtgggcatcaccgaaactgactcagtgatggcagcaaaactgttgcgctcggaagtgccagtgatcttggttgcgaacaaattcgactccgacagccagtgggctgacatggctgagttctacagcctcggccttggcgatccatacccagtttcagcccagcatggacgtggtggcgctgacgttttggacaaagtccttgaactcttcccagaagagcctcgctccaagtccatcgtggaaggccctcgtcgtgtcgcccttgtgggtaagccaaacgtgggtaagtcttcactgctcaacaagtttgctggcgagacccgctctgtcgtggacaatgttgcaggaaccaccgttgaccccgttgactccctgattcagctggatcaaaaactgtggaaattcgtggatactgctggtcttcgcaaaaaggtcaagactgcatctggccacgagtactacgcatcactgcgtacccacggtgccatcgatgcagctgagctgtgtgttttgcttatcgattcctccgaacccatcaccgagcaggatcagcgcgtgctcgcaatgatcaccgatgccggtaaggcactggttattgcgttcaacaagtgggatctcatggatgaagatcgccgcatcgatttggatcgcgaacttgatctccagttggcacacgtgccttgggcaaagcgcatcaacatctccgccaaaaccggtcgtgcactgcagcgcctcgagccagcaatgttggaagcgctcgacaactgggatcgccgtatctccactggtcagctgaacacctggctgcgtgaagcaattgctgcgaacccaccaccaatgcgtggcggacgtttgcctcgagtgctgtttgccacccaggcatctactcagccaccagtgatcgtactgttcaccaccggcttcctcgaagcaggttaccgacgatacctggagcgcaagttccgtgaacgtttcggctttgaaggcactccagtgcgaatcgctgtgcgtgttcgcgagcgccgcggcaagggcggaaacaagcagtaaagcttgattttccctaaaagcacttatccccacgttgaaaatgacgtggggataagtgctttttgttcaaaagagcggatttctaatcgtttacagtaattcctaaatgccgtgcaaatgctcccgacaggtcagcagcctgcagggatgagatcacggttccggacatggactccacgccactgatgcgctcgatatctaaaccgcgaagatccacattgctgagcacggcatgatcaaaggtgagcgaatgcaccgtgcagtctttaaaagcgatgcgttctgctctggcttggccaagatcaagctcgtcgatgacacagttctcaaagagcacatcccgtaacgatgcaccccgcagattgacaaacgacagcttagaatcagagattttcaaagcttggacggttgcttcatacatttcgacggcaccaaagcgggagtcggaaatcgttgcgttgcgccagatggagcgggctgccttaaaagatggagcattggctctttcgatgcgtgtttccacgaattgagcccggcgtagctcggtttcgtgtgcttccagcccaaggaattcacattcaatgaaaccagcaccagaaagatcgcgttcggaaagctcggcctcgttaaaacggcatgactctatctgctcattcgattcgatgtcttgagggtcagcgttgtcaaggcctgttaggcgaagttctttgatgcgtggtgctgcaacctgtgggcggcgcggtgatgccatgttttataagttccttgaatctggagtgctggtcttcgaccaccatactcaaggaacttgaccagaaagcttctctacttcaacaggacgtatagatcagtttggagtgttgcgggatccatgtcgggggaaggctcggtgacatagacctcccaacaaggcatatcgatctcatggcctgcagattcaagagcttccacgaatgaaccccatgcttggctcagtccgtcgaatgagccgatgtggctgattcgcgcaatttttccggcagggaccactgagtttttcagcacgatgccgttggcggctgaaacatctccctcaagtggttggctgactgggatgcccacttcaaagctgacggtgtcagttggttcggaggtgtacagagcaaatccggggccaattggcgcgatgcccttggcacccaaggtggggaagagcacttggtaggtttgatcgaatgctgcgggcatgtcgttcatggggtggttgtcaaagacagcgacgacggtcggaatctcgttgacagtgaggatctcgggttcagtgactggtggattcaacaggtacatggcgagggctcctaaagattggaagatctgcctgccagggtaccggaacgtgaaagtaaaaatgcatcacagcgatagggaagttccactggattgtcgggactgaaacccaaatgctcgtagagataccactgaaggttctgatcaacacgctctttgattttctctgacgcgtttaaccagtaggacctcgtgtgagcgagctggatgatttcttcaggggtgaggtgctgattccacgtggtgcgaatttctcgatcaattatccagggagctgcggtttctggggtgaatcccggcttgagtacatcgccggcatgcataatgcgactgagtcggtgtacccacgcgatggaggtgtccaggttattccacacgagcaggactgcaccctcaggtgcaatcacccgatcaaattccgctgaggcagccgtcacgtcaacccaatgccacgtttgtgcgcacgtaatcagatcaaccgcgttgtcacgtattcctgtgtgttctgctgtcgcttgccagcagggaaccgccggaagcgcggagcgaaacacccgcaacatgtccatgcttggatcaagggctaggacctgatcagctgttagctcactggttagttttccggtacctgcaccgacatccaggactcggccaaacccacgggctaactccacggcctcagccggatatccaggtcggacatcgtgataagtcgtgctgccttgggtaaaagcgctggcgctggttgctcgatgttgaagatcgctaaacgccggagcgtctcgttttgatactggtggaattgggggatgagctggatcattcatatcagatgttaatcctagcgggctaccaccaccttcactagcgatatatcgcttaacgtgctcatgagatacagtatctccttgtgcaacaaacgaaatccacacctttagataggtataaaaacctccccgggcccggcgcgcgaccgtccaagatgccggcgttggatgccaaattatggactctcaaagtggcgttgtcgcagcggccgtggagctttgtggcgtctgctggcatggcggcgtcttttatctgcaatgggttaacgcctgtgattgtgggtaaggcggtggatgaggctattggcacgagcgatctgcagcgattgtggttctggattgccatgttggcggttcttttcttaacggcgatgacggtgaactggattgctcggtacatgttggtgcggagccagcagttggtcagccatgatttgcgcatgttggtgactgatcggattcaagatccgcgtggttttgctggaaaagagcgcactgcgggtggattgttgtcgattgcgtcatcggatacgcagcgggtgggcgatatcgtcatgatgacggtgttcccggtggcggaattggcgtcgattatttatggcgccgtggtgatgtacagcattaatccgtggttgagtgtggctgtgctgattggtggaccgctgctggttgtggtggctattcaggtctcaaagccgttgcagaagcgttcgggtgctcgtcagcaggcggtggcacaggctgcggctactgcaactgatgtggtgcagggcttgagaattttgaagggtttgggcgcgattgtcacggtgcgccgtcggtacgaggcgatttctggtgaggcttatcggaagacggttcatgcggatgctgcggaagctcgcttgaatggtgtcaccgatgcggcgggcgccatctttgtgtccgcgttgggtattggagcaggatttttggcgctgcaaggtcagatgagtattggtgatttgatcacggttgtgggactcacacagtttttgatcatgccgatgaccatgcttggtcgaaatgtggcatcgcgctgggcatcggcggaggcgtcggcaaagcgtattaggggagtgctcggtgctgattttgagagagtgtctgcgcatgatgcggacaaggctgaggagattatccaacaacttgccaaaggtttgacggttattcgaggcactgatgagcagctcgttgaggtattagagcagttgccacgtactcgggtgattgtggctcctcatgcggcggatctttttgatcaaagtgtcagggacaatgtgcatcccgtggcagaggtcgcggagaaagccattgaagttgcctcctgtgacgatattccaggtggtagttccaagattgtgggcgagggtggacggttgctctcgggtggtcagcgtcagcgcgttgcactggctcgggcgattgcttttgatccagaggtgttggtgcttcaagatcccacaacggcagtggattctgtgacggagcaaaacattgctcagcaagtggcagcacaccgtgcaggaaaagtgaccattgtgtttagtgaggcacccgcgtggagtgcggtggctgatcaacacgttgaggcagctgctttgcgggaggttatgaaatgagtggggagacgtcgaaaagcatgcgctttccgttggccagcctgccgcaagtgcggcgcgaggtggcccggcaggtgggtcgtattccgcgggcgaagtggtggtttttaggcgcgctggtgttgctgagtgcgggcgcttatgcgtcggtgctggtgccgcaggtgctggggcggattgtggatctggtgtccgatggcgcgcagatgcgtgattttgttgagctcagtgtgattctcattgcggtggcaattgccggcgcggtgctcagtgcgtgcgggttctatgtggtgtcgcggatttctgagaagattatcgccaatttgagggaagatatggtgggcaccgcgcttgggttgcccacgcaccaggtggaagatgcgggctctggcgatttggtgagccgctccaccgatgatgtctccgagctatccgcagcggtgacagagaccgtcccgattttaagttcctcactgtttaccattgccgcgacgatcattgcgctgttttctttggactggcaatttgtgctcattcctgtcgtggtggcgccggtgtactacttcgcgtccaagcactatttgagcaaggcgccggatcggtatgcggcagaacgcgcggcgatggcggagcgtgcgcgaaaggtacttgaggctattcgcgggcgtgcaactgtgcgggcgtattccatggaagatgccatgcataatcagattgatcaggcgtcgtggtctgtggtggtcaagggtattcgtgcgcgcaccaccatgttgattttgaacatgtggatgctgtttgcggaattcctcatgctcgcggtcgcgttggtgatcggctacaagctggtcattgatgatgcgctgacgatcggcgcggttaccggtgccgtgctgatgattattcgtctgcgtggcccgatgaatatgttcatgcgcgtgctcgacaccattcaatccggctatgcgtcgctggcgcgcatcgtgggagttgttgcggatccgccgattcctgtgcccgacagcggtgtgaaagcacctcagggcaaagtggaattgcgcaacgtcagctttagctatggcgattcctgggcggtgaaagacatcgacatcacgatcaattccggcgaaactgtcgcgctcgtgggcgcatctggcgcaggtaagacgacggtcgccgccttgctggcgggcttgcgggtgccagatcaagggcaagtgcttgtcgacgacttccccgtctctcacctctctgaccgcgagcgtatcgcccgcttggccatggtcagccaggaggttcatgttttctccggcacgctgcgccaggatctcaccttggctaaaccagatgcctccgatgaggaattagcgcatgctcttgggcaagttaatgcccttgactggttggagagtcttccagaaggactggacacggtcgttggtgcgcgaggaatccagctagaaccagtggtggctcagcagttggcgttggcccgggtgttgttgctcaatccggcgatcgtcatcatggatgaagccacggcagaagcaggatcggcgggtgccagcgcactggaagaggctgcagatgcagtgagcaagaaccgttccgcattggtggtggcgcaccggttggatcaggcatcgcgggctgatcagattctggtgatggataagggggaggttgtggaatccggtactcaccaggagttattggatcacgggggtatttatcagcgtctgtggactgcgtggagtgtcggaagatagttgactgttcaatgcgttgaacattagtattcatccctatggatacctcgactgtgttgttcgcatttggactcaccctatttgccggtcttgccaccggcatcggcggtctcatcgccgtagcgcgcaaaaccgtcaccgaaggattcctcgcaggatcactcggcttctctgtcggcgtgatgctgtacgtatcctttgtggaaattctacccggcgcctttgatgaattaaccagtgtttggggagaaaaaggcggaagttgggccgctgttatcggcttcttcggtggcatcgcgctgatcgccatcatcgaccgcttagtccccacggcgattaacccccacgagccctccaccgtgggaggcgccgttgaaggattcgagcgccgcaaccgcatgatgaaaatgggtgtgctcactgcgctggccatcgcgatccacaactttcccgaaggtttcgctacattcttggccggattgtccgatccaatgatcgcgatccctgtggccgtggcaattgccattcacaatattccagagggcattgcggtggcggtgccactgagggaagctacagggtcacgtcgaaaagcattaggttgggcgaccctctccggccttgctgagcccgccggcgccctcatcggattcctgctgctcatgccctttatcggaccagaagcactcggcctgtgcttcgccgcagttgccggcgtgatggtgttcatcagcgtcgatgaactactgcccactgccatctccagcggcaaacaccacaccgccatctacggactcatcgctggcatggcagtcatggcgatcagcctgctgctgtttatctagcgttcagccgcaacaagcatccggtcaatgttggtcaacacctcatcaacataggccggattaacgccgcgctcccgccgcgccttcaacagctcctcctgggccgccttaattgccccgacacgcgcatgatgcgcgcgctgatgcagcttatcgacgttctcctgcagttcatcagcgtcaatttcttgcgagaaccaattcttgatcgccaccatctgctccatcggcaactccgtggtatccaccaaatacgttgttgcggccttgtgagccctctctgtcagcgcggcgatactctcatcgcccgcagcatcgggacccttatccaagctgagcttccgcatcagccacggcaacgtcaaaccagggcccaccatggtgattaagagaacgaccagcgcaatgacctgcaactcgtggtgatacgggaaaatatcctccggaatagacagcaccagcgccaacgtcaccaaaccgcgcatgcccgcccacgtcatcagcaacgattcctgcagtcgaagaggcgcccgcaatgaactattggtcgcacccttcttatcgatcttgaaacgattgcgcttatacgccgcgaacatccacacaccacggacaacgatcgccaccaccgagagcacaatgcccacgaccacggcatgccacagctcagatccaacttcatcaatcgcagcgcgcacattcaggccgatcaaaccaaaggcaacgccagtaaacagcacctcaatggttccccagaacgcagaacccgttagacgatcctccgcaccaatcgacgccctcgaattcatctccactgcagcgatcacaatggcgataacgcccgaaccgccgatttcttccgccaccacataaatggcaaacggcagcacccacgtaaacgcatttcgagcctcaacggaactcacgtgatcggtaaaccacgcagccgcccggccaataaccaagcccaaaataacggcagcaagacacgaccacaagaattccaaaacacccgttgaccaggacaaatcctcaccagcgaccagggcagctaaagccacatggaacgccacgatgctggctgcatcattaaacagaccctccgtctgcaaagtggtggtgatgcgcttcgggattcccgcaggttccgccactgcatcaacagcaacaggatccggtggagcaatagccgcagccaacatgatcgcaccagcaagaccaatgccaggaagcaacagcatggatgcacccgtgagtgccgcgatggtcacgaacaccaacaacaccgacatcgtgatgatggtagacatctgcgacctaatcaccgcccacgatgacttcctcgccagcgcccacagcagcggcggaatgaaaataggcaacatcagatcggccgggatagtaaattccggcaaaaatggcaacaacgctccacctgcggcgacaatagtcatcaaagcaggccaggggagtccggttttatcgccgatggccaccacaatcacggtggcgagcagcaatgtaatgagcatgaacaatatcgtcatgaataaggtctcttcgggtcaggtctgtcaggtttgtcagtttttcagtaaacagttcctatttttccctgattatgctgctgcatgggagagcgcacaccaattgaaagcaacttcacaggaagtgttcagttgtgagtttttggggtgtcgtgtggcgcccgtttaaggggtcgaatttctgcaatgggttcgagtgtgggtgcgctctgttcaggcatttgtaggcgattctggagcgtcgattttttcgggttcggggtggcatttttagacgagtggagccatgtgtccgtttgagaccaaggaacgagtttcgccctgtctgtttggtttaatacgcacgttttgacgcgcaagaactgcagatcgagaccaaagagaggtagatttttgaggtctttggtctcgatctgcagtctttgattttgccctagccagatctacttttcagccgtgatcttgatggttcctacctctgcgtcataggttgagttcatcaacgcatgttccgcctcggccgaaagatccatttgggatagcgcacctgcccaatatcttaaaatccgtcccgcttcaccggcaggatcatccgcaatagcatcaagatcgatatcaatggtgagtttcatgttttatccagcctgacaaatagagaaaacctaggggagaaaatacatcctcacctaggctaattgtcggactaacaggatttgaacctgcgacccctacacccccagtgtagtgcgctaccaagctgcgccatagtccgccgttgtgttcttaaccctcgggctgagccaacgtgaataggttacatcagtgtgatctggaaagtgaaatccgctggtcataacctattgcacgtgtggggaaactagtcgacatctcctgtggaatagacccacgcgccgttgaccttgcggaatgtggagtcttcttcttggacgccggaggcgagccccttgtagaaggcttggaattttacggtgccggtggaatcgaagggtccaccgccggtggtctcgaggatgtcgaggcggtagaaatcaattcccatatcgaggccgagttcgcttggccgggtttctggatcccaagtgtcaagaaggtactgggaatttccaacagcaaaggcggtgaaccgagatcgcatgagcgcttcagcggtgggggccacccattcgccggagtgaaagcggtagcagcactcaccgtaggtaaggccagttccgcaggggcagcgtttacccaactcaaaatccacgctagttcacctcgtcgtcgatgacgattccctgcgcgagcagttgggtaatcgagcaggaattagatgcggcccgaagtgaagcactgtcagcatcgctgaggttgccgatcaaagagatctttcggcggagtttgatctggccgtggtcggctgattgttcctgggagatcgtcactttgacatcgtcaaggcctttgatgcggttgtcgatggctgcttgtttgatcgtttgagagtttgcagcagcaagcgcggaaaccagcagggaagtaggggtgaagccgaggtttttgccaccctgggatttgtcgcggtcggtgatgaaattgtgaccaccggtgcggatggctgcgccgtatttgctggctttgatggttgaggcttcggcgacaaactccggaagatcctcacagacgttttctggaaccaggtagggctcgacccagttcgcgatgatccgggctgcacgctgtgcggtgccatctttggtgagcaggtgatctgccttgtccaaagtcatcaaggatttagggtagcgagtgactctgaagatgagctgcgcgttgtccacgccgacggtttggtcggtgggggaatgcagtaaaagcagtggtttgcggagcctgcggaggtgatcttcggggttgacctctgcaaggtcttcgaggaattcgcgggaaatggtgacatcccggcctccgagctgcagagtgacagcaccttgatcatctacatcacatatgcgatcagcaaagtgcaggactgcgtgcgcaggatcaaaaggtgcacctatcgttgctactgctttgaggcaggagattttggtggcagctttcagtgatgctgcaccacccaaggagtgtccaatgagcaactgtggagcggagtagtgttccgtcaaccactgcgaggccgccacgatatcgtccacattggagttgaaggtggttttggagaagtcaccttctgattggctcagtcctgggaaatcgaaacgcaggcaggcgacgccggattctgcgagtgttttactgactcgcgcggcggctggcgtgaaccgtgagccggtgaaacagtgggcaaacattgcataggcaatgggatctgtatctggaagatctaacgtcgcggccatcatcaacccttgtgatgatggcaccttcacgctaactgaatgcaccgggagcaaacctttcgacaaagctatttcatcatcactttatgcatatctttcgcgcaggtcaccatgcgtgcggtatgtcgttgcacaactcttacccaccagtgcaatgtaggtcacgtcgtatcacgtctgagggtgattgagtagggttaaacagatgaattcatttagctcaccggaggtataaccgtggccggttttgattggttttggaaggcccttggcggcaaatcgggcagaaaccaaaaacgtagcgtggcaattgtcaatcaggtagaaaaccatgcagcggaattagacgcgctggatgatgttgcattggcgcagcgtgccaaggatctagccagtggtggacgcattgacaatcatgcggaattcctcgccattttgggtgtggcatcgcagcggacattggggctgaagccgtatccggtgcaatcacaggcggtgttgcgtctcattgaaggcgatgtggtgcacatggctaccggtgagggcaagactttggtgggcgcgatggcggccaccggtctggggttgatgggcaagcgagtccattcgattaccgtcaatgattatttggcggtgcgcgatgccgaatggatgcggccattggtcgaatttttcggtctgagcgtggcgagcatcagcgagaagatggatgcaggggagcgtcgacaagcatataaagccgcaattgtctacggacctgtcaatgaaatcggctttgacgtgctgcgtgatcagctaattacccggcgcgaagacgccgtgcagcatggcgccgacgtcgcgattatcgatgaggccgattccgtgcttgtcgacgaggccctggtgccactcgtcctcgccggcaaccagcccggccatgcgccgcgcggcaaaatcaccgatgtggtgcgctcgttgaaagaaaacgacgattacaccatcgacgatgatcgtcgcaacgtcttcctcaccgacaagggtgccgccaaattagagcagcagctgggcatcagcagcctctacgacgatgagcacgtcggctcgacgctcgtgcaggtcaacctcgccctccacgcgcaggcactgctcatccgcgacatccactacatcgtccgcgacagcaaggtcttgcttatcgacgcctcccgcggccgtgtcgccgacctgcagcgctggcccgacggcctgcaagcagcagtggaggccaaggaaggtctcgcggtttctgaaggcggcaagatccttgacaccatcacacttcaggcgttgattggtcgctacccaatggcatgcggcatgacaggtaccgccgtggaggcaaccgatcagctacgcaccttctatgacttgcatgtttctgtcattgagcgcaatcatccgctgaagcgctttgatgaagctgaccgtatctacgccaccatggcggagaaaaaccgcgccatcatcgatgaaatcgcactccttcacagcacggggcagccagtcctggtgggtacccacgatgtggcagagtcggaagaactcgccactgcactgcgtgaactcaacatcgaagtaagcgttctcaacgccaagaatgatgccgaagaagcccagatcatcgcagaggctggcgatattggacgagtgaccgtttccactcagatggccggccgcggtaccgatattcgcctcggtggcgccgatgaagccgactacgatgaagtggtgaaactcggtggactcgccgttatcggcaccgcccgccaccgttctcagcgcctggacaaccagctgcgcggacgtgcgggacgacaaggagatccaggcctgagccttttctttgtctccctcgatgatgatgtggtggtctcaggcgggtcaggggagagcgtgagcgcgcaacccgatgccaccgggctgattgactcagatcgcatccgcgattgggtcggacactgccagcgcgtcaccgaaggacagctgctggaaatccactcccagagctggaattacaacaagctccttgccgatcaacgcgtgatcattgacgagcgccgcgaacgcctcctcgacaccgccttagcgtgggaggaactggcacagcatgcaccagcgcgggctgcagagcttgaagaccttgatcagtccgtgagggaacaggcagcacgagacatcatgctgtaccacctcgattacaactggtcagagcacctcgcgttgatggatgatgtccgcgaatccattcacctgcgcgccatcgccagggaaaccccccttgatgaataccaccgcatcgctgtgcgtgaattcaaggatttggcacaacgcgctgtcgatgatgcggtgtccacgttcaagtctgtgaccatcgatcacgagggtgcccatttggatgatgagggcttggcgcgtccatcagcaacgtggacctacatggtctctgacaacccacttgcgggtagtggtaactcagtgatcagtggcataggaaatatctttagataacctgagaactatgaaattccagctcacggcgttttttcaggaaattctaggatcttacggagggtaactccgcactcaacatctagacaaaggctatgatgaaaatcgttaagaataatgtcgacacggaggaagtttaatgagcgacaacaacggcaccccggagccacaggtcgagaccacctcagtattccgcgctgatctactgaaggaaatggagtcgagcaccggtactgctccagcctccacaggagctgaaaaccttcctgcaggatctgctcttcttgtagtcaagcgtggaccaaatgcaggcgctcgattccttctggaccagccaaccacgaccgctggtcgtcacccagaaagtgacatcttccttgatgatgtcaccgtttcacgtcgccacgcagagttccgcatcaatgaaggtgaatttgaagtcgtggacgtagggtccctcaacggaacctacgttaaccgcgagccacgcaacgctcaggtcatgcagaccggtgatgagatccagattggcaagttccgcctggttttcctcgcaggccctgctgagtaaaaacacttcctaggaaagttctttgcagtgtttcactgcaaacagtgcggttgcaggatacatacctatcttgcaaccgttttgtgtatagaatgcctaaaatagtggtacaagtccctgtccgcccatttaattcacagcaggtagcagcaacatcgtgagtgcactccgtaaaacatccccaaacggctccatcggcgcatccgccaccagaaccgttccggtgaaaccaaccaagactatgtcaattggtgtggtacttgaacgtctaaacgcagagttccccgatgtcactgtgtccaaaattcgcttcctcgaatcagaggggctgattacccctgagcgaaccgcatctggataccgccgttttacggaatcagatgtggaacgcctccgctacatcctggtcacccagcgtgacaactaccttccgctgaaggtcatcagggaacagctggaagccatggacaacggctctgtcaccgccatccttggttcctcctcggagcctttggtcagcccggagaagtttcaggcacctgcgattactcgcctcactgactctgatgtggccgaaaaggctggcgtcaacgtcgaattggttgttgatttagtcaacgcccgattgattaagccggacgccgccggatttttcaccaacgatgacgtggcgatcgccagcaccgcagctagcctgaaagcaatgggctttgatctccgtcgactgaaatccctgggaaatgcggcatcgcgccaggcagatcttatttcccaagtggcatctccgattgcgcagggaaaaagcgatgttgcccgccagcaagctgaagaaatggcacaacaaatgtgctccctagttgtgtcaatgcacgcctccttggtgaaaaacgcaactcgcgagcagcttggatactgatagaaaaaatgagttttgttgaacttgaattccatggcattcacaccatggaaccagatggctttacctgcgcgctgttccgatgggatgaagggaacaaaatccttcccatctggatcgacgttgatgacgccctaaaaatccaggcatatctcgctggattcaacccacgaaggccaacggcacatgaattgctcgcggaagcattccagcgcctcactccgtgggtagccagcctgcagatcgtctcccactttgaaggcgtttacatggctaccatcactacctctgaagatgagcaatttgatgcccgcccaagcgatgtgatcatgctgtcacagctgctcgaggtgccaatttctatcgatgaggaaattctgcagcaaactgccttctatatcaatgatgaggatatggagtccatctttgacatcgtcattgatcgcagcaaggcatccggacatcctgatggggaatctgcttcaggcgacgctcaagcagatgctgatttccaacagttgatgcagagcctcggcgtttttgaagatgatctcttcagcgcaccggattctccaggcgacggacttgatggcgacttcggcgaggaaggcccctcatcggaagaaaagccagagaattcctaaaatgtgactaatcacaccctcagatttcaacttgctgggggtgtttttggcgtgttagcagattttagcttgactctggtctagggtagagaccagacttatagctaagttgcatgcttagaattaacacgcatgttgttttgaataaaacatgggtgctgaataatcggagaaactagtgtacgaagacaagaactaccagggagaaatcttcaacggtgtccctgttcaggagaccttatttgaggtcggccctgacgaacaggtcggctaccgcgtcccaacagcctgccaagttgcggggatcacctaccgccagctggattactgggcacgcaccaaacttgtcgtgccaaccattcgtggtgcacgcggatcaggctctcagcgcctgtactccttcaaggacatccttgttctgaagattgttaagcggctgctggacaccggtatttctctgcagaacattcgcctcgccgtggataagctccgcgacatgggcaccaacgacctggcagagatcaccctggtttctgacggcaccaccgtctacgagtgccgatccaacgaagaggtcatcgacttgctcggtggtggacagggtgtattcggcattgcagttccaggcatcatgaaggaactcaccggcgatatttcttccttcccatctgagcgcatcgatgaggaatttcaggcagagaccatcaactttcaagatgagctcgcagcccgccggagccgacgcacctcctaaaaactcagcgcagtaaatcttcaagcccgtgcaccgtaggtctctccgaacctatggcgcacgggcttgatagcttttgtggctattgttccaactcgcgtcgacgttgtgccgcaatgcgtaggcgtgcttcgcgttcgctttgttccttgctgtggagttcctcaaagagtttttcatcggcgtcatctactttgagcaagaatcgcgcacccgcggaggccgctccgccaaggatgaacacaacccagaaatatggcacgttgaaaacaaacaagcctaggaagaacgagaccatcacgacagcccaaatggcggagtcgatctgcttgagcttctttcctcgctgtaggaccaggtctaattctttctcggtatcgtcttgcacgggtgtcacggcggtgcttgcctgttgttcgggaagatctgtgaacaagacatctatttcaccggctgtgcgtgcgattgctgcggcgccggttcgggtatcgaattcgtcgatgtcgaggtatccgtctgcaaaatatgacccaagtcggtcgagggcttgggatcgctcgatgtcgcctattcgttggtgagccctgtcgttcatagttcaagtataaacacgttttcgagtgctgccggtggtgcgaaaatccaaaactcccattttgacaagtgttcattgtccaaatgggagttttttcagcggtcggcttagagtccgaatgcctcgcggagagctgcatcgatctgctcggtggttgttgcctgcgtagcggtgccgttgtggctggtggcgaaatcactgagcacggaatccactggatcgtggcctacatgaacaacgtggagtgagatgttgtctgcgaatgcggcgctgagatcattcaagaatgcttcgtcggtgtattcaccagctgagcctgaggtcacgatgacaacgcgcattggctgtccatcgggggagccttccttggcgatctgggttgcagcaacgacagaagcgcgggtcagcggaacgccaccggtgccgaggcgaacaactgcgccggcagagttttctccactggaggaatcagggaaggaaacgtttgcgcgccatcccttggtgactcctgggttgagtggggaagagtagttgtttagtgctacctggttgccctgtgcaccagtttcgcgggcgaggttggccagagtccgggaagtaaccgtgtggtaggtttcctggctgccgtcaacaactcgatccatgttggatgaggtatccaggttgatgatggtatcggatggggaagcagcggcgggctcgaccggggtctcgcttggttgcgcctcagtagtttctgccgcggattcgcttgaagcttgggtgagaacactttcaagcgcggagttatcggcgttgccggtgtcgaagctgaagctactgaaatcagaggcggcgcgggcttggtcttcagagataccgtttccagcgttgatggcaacagcccacacaggtacttctgcgctgtctactgcttcaaaggtgtagccctctggaagttctgctccttcaacggtggcaaacgcaggggagtcggcagctccagttgcggtgacatcggcgtcacggttgagcgcagcagcggcagcttctggggtttcagccagcgccagcgctacggctgcggatgctccggagttagtggcaacgggaagagctacctggtcaagggtgattgttgaggcgtcggtgcctgaagcagctgcgaggcctgcctgtgcggagccaacctggggccaagagctttcagagctgcttgctacggcaccggtttcagcaagtgcggtggcagcatcagaacgagaaccagcgaacaggtacgtggcagcggggacgttgccgtccacagcttccgcctcaacacagaaatcacggctgacaggtgatgagtcattaaatttgttcactaattcttcggctgcggtggaatcgccaccaacgggcagactcaagtttccggagatgcactcttgtgaggtggtcgtggtggagccagaatcatctgaacggttaaaaagccacaccacaagtgccacgatgagagcgacgatggcaatcaacgcaatggttagcgatttagataaccttaagtttgaattcccacttgaatggcgtgccacgtttctccctcgctgtattccccgaaaatccggaccagaaacctacattgacaagtctaattttctaaatactagcctgtagagcttgtttagtaatggagacaagccggtcacggatgggttttgctcgttcagacagctcgcgttgtctactgacatattcggctttgccctcggcggtctcaatggggacgtagccaaagccgtatccgcggacgtcgtaaggcgaagcctccatgtccaagatgcgggtgtcgcgggctagttcaaacgcgtccaagaaaagatcacctggcacaagagggccaagctttgcggaccatttgtatagatccatcgtggcatgcagacaaccacattgatcgttgcgtggctgatcttcgcgggttaacaccgtgaggttcaacgggatggctggtgtggtgaagaatcggtaggcatcaaagtgggtgcatttgatgttgtggctttccaccacacggtcggtttccgatggggtaaggcgcaggggaaggtcatggcggagatcgtttgatttgtacaccattgcccattcgtgcagaccaaaacaatcaaattgggcgtggttgtcgcgggtggcggacaacagttcgtggatgtagcgcacagaggacccacggcgttgcatataggaggccaggtcaagctggacgccggctgcgtgatggagggaggcgtcgacaagcaaaaaatcgcgcatggtggcatgcggcggtgtgccttctagaaacacgccgatgccggggtgccaggtttttaggtgcgcgacgcgcacggggtagtactcgaagaggaagtcgaagacggggtgcttgatatgcgcttgtcgacgcttcaagtggtctttggtgaatgaatcagcccgcgcgtggtgggcgcgggctagttccatccactcatcctcgctcaatacgcggaggtgaaaagtgtccaacacagttactatttctagtcgtcggagctttcgtgagtccaatcgttgacggtgcccacgtattcttcgatgagatcctccagcgtaatcacgccgagaagctcacctttgaggcgaacctgagccatgtgcgcggagcggtagtgcataaaatccaagacgtcatccatgaggccgtcggcatccacattgctcaaagggcgcagtgcagaacgcggaatggtctcggagggatccatctcaggatcagccagacgaggcaaaatatccttgatgtggatataacccaagtaggatccatcgcggccggtgacagggaagcgggagaaaccggtctcgcggactgcttcctccaactggtgcaaggtcgggccagatttaccgaacgccagcgtgcgcacgtcctcatccttaatcaccagttccttgatggaacgctgctcagagcgcagcgccttggacaggcgggcgtgctcttcagcatcaaggaggccttcggaacgggactcggaaatcattgatgccagctgctctgggtccacggtggaatccagctcgtttttttgctccacaccaaaggcgcgaagggtcagacgggcgatccagttcatgaactcgatcaacgggcgggtaatcttcacaaacgcaatgagcactggagcaagccacatgcctaaggtttcagggccagcaatagcgatgttctttggcaccatttcaccaaagagaatgtgcaaccaggtgatgatcgccagtgcgatgacgaaggaaattgggtggatcaaatcatttggaacaccccaggaggtgaaaggcacctcaatgaagtgggcgatcgcaggttctgcgactttacccagaatcagagaacagaccgtaataccgaactgagcgcccgccaacatgatggagaggtgctcggttgcgtagagaaccttttcagctccctttttaccctgggataccagggaatccaggcggtcccggcgcgaggaaatcagtgcgaactccgcggccacgaagaaggcgttggcggaaagaaggacgataattagaaggacagttgcccaaatactcacttttcgtactcctttgcttcttcatgggtgatgggggtgagaacggctttgtcgatgcgtcgatcttccatgaccgttactcgtgcgatccagcgtccggagaagccggattcgaattcatccatggttggggtatcggtcagtgggagtagggcgacatcgccgacgcgaggaatggcgccgactgtgtacatgatcaagccgccgagggtttcgtaggggccgtcaggggagacgtacccgacgcgtttttcgagttcatcgatgcggaccaggccggagacttcccagctggcgccgaattgttggaaatcgcgttcggcgtcggagtcgtcgtgctcatcgtggatttcgccgaggatttcctccacgacgtcttcgatggtgaccatgcctgcggttccgccgtattcatcggcaaccaaaataacttgggagccggcggagcggacagcgttgaggacagagtcgccgtcaaggctggctggtaccacaggaattttgcgggctagatcgcgcaccatggtggtggcgcgttctgcctgcactacagagaatgcgtccttgatgtggaccatgccgatggtttcatccaagtcgccttcggtgactgggaagcgggagtgacccgtttccagggcaagctcgatcaaatcattgacggtgtctgtggcacgcaatgattcaatggtggagcgaggtgtcatgaattcatcagcggtggcgtcaccgaactgcagggatcggttgatcaccgctgcggtgttttgatccagtccgccgctttccgcggagctgcgtaccaaggcggtgagctcttgggaggaacgggcagaggcaagctcttcggctggttcaataccaagtttgcggacaataaagtttgcagacttgttcatgccgttaataaacggcttgagaaccatgttgaaccaattgacagggtggacaacaaaacgtgccacgcccaacgggttggtgatcgcccagtttttgggaaccaactcaccaaaaaccatggagagggtagttgccaccaacagtgcgatgatgagggctactgcggagcttgctgattcatttaatcccaccagctcaagtgctggggtgaagaatttggccaaaaccggctctgcgaggaagcctgtggcaagtgtcgtgatcgtgatgcccagctgggcaccagagagcacgaacgacagattttgatgatccctctgcactgcgcgggcgctgctgtcgcctttttgcttcacatgtgtttctacagtggatttttctaagccggtgagtgcgaactcaatggccacgaatagtccggtgctcgcggtaagaagcacgaagcctagcagtgagaggatgcttatgagtatgtccattagcgtggtttaagctgttgcccttagaagcggtgaaagcctgttcagcttcgcgtgccgtgggggagttttagctcttgggaccgtctttccttgaagtctgacgcctcgggttggagcggcccgttgatctggatccgctttgtccgcgcctgcgtggattccggctggaacctctggaatcagaacgattatgggtatttttttgttcccgctttggctgctgctgtccaggtgctggaagagcaacgcctgacgggcgtcgtgcaccagtaattttagccaattcaggtgagttttcgttgacttttacctcagcggctgtcacgcctgctttttggaaaagttcacggacttccttgatttgttcgtccattactagagtcacaactgtaccggaagttccggctcgtgcagtacgaccagcgcggtgcaaatacgctttgtgttctgctgggggatcaacgtgcacaacaagcgagacgtcatccacgtcaatgccacgggcggcgatatcggtggccaccaagacggggattgatccatcggcgaaaccagccaaagcgttggtgcgggtggactgacctttatcgccgtgaatacccactgcgttgacacccacgcggcgcagtttcttcacctgtcgatccacaccgtgcttggtgcgcatgaacatgatggttttgccttcacgtgcagcgatgctcaagacaacggaattgcgaggatcgcgtccgccaaccagaagtcggtagtgttccatggtgtccactgctgcctgaacaggagcggtggagtgtgtgatggggttgtggaggtagcgatcgaccaatttgctcacatcgccgtccaacgttgccgaaaacagcagacgttgaccatttttaggggttaggtccatgagcttttttacctgtggcaaaaagcccatgtcggccatctgatcggcttcatccaacgctgtcacggaaacatcagcgagggagagcttcttctggttgatcaaatcttgggcgcggccaggggtggcaaccaagatatccactggtgtggcaagtgcggtgatgttgcggttgatgttgacgccaccgaccacctcgaggacgcgcagacccataacgcgggcgggatcgtcgaggcgttcacgcacctgagctgctagttcacgggtgggaaccaggacaagcccgcgggggcgacctggtttggaggcgcccgagcgcgcgagtcgggtgatcatgggaagcccaaaggtgaaggttttaccagagccggtgggtccacggccgaggacatctttgccagcgagcgcatcggggatggctgcttcttggatggggaatgcctcggtgattccctgactgcgaagttcgcgcacaatctcgtcgggaagcttgagttctagaaaggtagtcattgcccactaactctagtcggtgctggttgaaaagtgatcatgggaacttttaatcgctgagctagtgcttttgcgacacacctcttgcgaatgttgattaggttaggcaagccatatttacagggtgttgtgaaagcataagggagcaaggaaacatgggcaagggatttaccggcgctattttgaccgtcatgggcgtgaaatcgcatatcgccaccaccacgggaaaaaccgtgatcaatgaccgcatggtgaccattcattttcattccgagacgctgctcaacacggaaggtgaagtccccggcgattggctgcgtctgtggttcccgcacgagagccgacctggaaagctctaccaacgcgcctacaccttgaccaacgtggatgccgatgccggtacctttgacctggcttttgtgctgcacgagccgctggggcccgcctcggcgtgggcgacgcgctgcgaggccggggaaagcctggaagtcatgcgctacccaggaattccgttcgccatcccagatccagcgccgcgtggcttccttttcttaggcgatctcacctcttacccagcgatctgctcgattctggagaccttggacggtgaaatccctgcgaccgcgtatcttatcgcccacgatccacttgattacaccttcgattttccccagggcgagcacatcaccgcgcagtggatttccaacgaacaatccttcattgatcacatcgctgacacggattacaccgatttttatacctggatcggcgcggaatcctccgaaacccgtgcggccaagaagcatctgcagacccacgccggcatgcccaagacgcacatgaacgcgcaaggttattggaacaagggcagagccatgggtaaaagcaattaaaagatttttgcttatcgacgcccacctccggcgaatccctggcagcacgcgaaaaacccctcacaatctaaggtgactgtgaggggttttggcgttgtgttaaaaggagagcctttaagcttcaacctcggagcggtcgccggaccactcggtgtggaaggagccatccttgtcgatgcgcttgtaggtgtgcgcaccgaagaagtcgcgctgtccttggatcagggctgctggcagacgctctgcacgcaggctgtcgtagtaggacagggaggaagcgaacactgggattggcaggccaagctgggtggcggtgacaatcacgcgacgccatgaatcgatgaggtcgccgagctcgctcttgaagtaaggatcgagcagcagggactcaagttcagcgtttgcatcgtatgcttcgacgatgcggttgaggaacttagcgcgaatgatgcagccgccgcgccagatggtagcgaggtcgcgagggtcaacgtcccagttgttctcgtcggagccagccttgatctcgtcgaagccctgtgcgtaagcaacaagcttggatgcgtacagtgcacggcgaacgtcttcgacgaactgtgccttgtccacgccaagtgcttccagatcggtgaggacacctgcaggtaggttgccctgtgctgcagcgcgctggctggttgcgccggagagtgcacgtgcgaaaacagcttcgccgatgccggtggtagcaatacccagatcaagagcagccttgacggtccaacgtccggtgcccttctgacctgcagcgtcaacgatgacgtcgattagtggcttgccggtttcagcatccacctgggagagaacctctgcggtgatttcgatgaggtaggaatccaggtcgcctgcgttccattccttgaaaacctcagcgatttcagctggctgcatgcctgctgcgtagcggagaaggtggtatgcctcgccgatgacctgcatgtcggcgtactcgatgccgttgtggaccatcttgacgaagtggccggcgccgtctgggccgatgtgggtgacacatggggtgccgtcaacgttggcagcgatggactcaagcagtggtccgagggactcgtaggactttgctgggccaccaggcatgatggatgggccgttgagtgcgccttcttcgccgccggagataccagcaccgacgaagtggagaccgcgtgcggagatttccttctcgcgacgaatggtgtcggtgtagagggcgttgccgccgtcgatgatgatgtcgccttcgtccatggcatctgccagctggttgatgactgcgtcggtggcgttaccagcctgaaccatgatgatggcgcggcgtggcttttccagggatgctacgaactcttcgacggttgcagaagggatgaagttgccttcggagccgtgatcggcgatgagcttgtcggttttgtcagtgctgcggttgtagacagcgacagtgttgccgttgcgggcgaagttgcgggcgaggtttgagcccattactgctaggcctacaacgccgatctgtgcgagattatctccattagtcatgttattgatcgtacttgacggcatagcccggtgtcagcaaaatcggcctaaaaggtgtgaccatttgggggtagtggcgattttaccaggtcacaggaggtgaaaatccaaccattttaggccgactagagtaattaattatgacttcccgcgatgatcaaccccaagatctgctttcgcttgcagaacttgccgccaccagagctttaaccacagacgaacttgaagcactcaacaacgccaattatggcctcgaccgcaatctggggctgcgctacaccaccatcgagcccggccgggtggtcagcgaacttcacgtggcatccaagcacctgcaagtggtgggcttggtcaacggtggtgtctacgccgccatcgccgaatccactggatcagtcgccagcatgatttccgcccctggaaaaatggtcgtcggcatcaacaacaacaccgacttcatttctgctgtgagctccggtgtcatcgtggccgaagcaacgccgattcagctaggtggccgcacccatctgtggcagatcgaatgcacccaccgcggagaagtcgtcgcacgaaccacactgcgcaccatggtgctgaacaagtagccctatactcgggcaccatgactacatggaaagagctcacagataacaacccagcgcactcagaaaactacgcgcagcgctggcgaaacctcgccgcagcaggcaatgatatttacggcgaagcccgcctcattgatgccatggcacccaggggagcgaaaatcttggatgctggctgcggccagggacgcatcggtggctacctgtccaagcaaggccacgatgttctaggcacagaccttgatcccatcctgattgattacgccaagcaggactttccagaagctcgctgggtggtgggagatctctctgttgatcagatctcagagactgattttgatctcattgtctccgccggcaacgtcatgggctttctcgctgaggatggtcgcgaacctgcactagccaacattcaccgcgcactgggcgccgatggccgcgctgtcatcggtttcggcgcaggacgtggatgggtctttggagacttcctcgaagtcgcagaacgcgtgggcctcgagttggaaaatgcttttgagtcttgggatcttaagccttttgtccaaggctctgagttcttagtggcggtatttaccaagaagtaacacctctatcttgcacctgatctggcgtagactcataagttatgagcaccgtaacggcagtgcaggtcaacggcctaaaagtttccatatcgtccggtttttcacgcaagaaaacaaaaacgatcttgcatgatctcgatttcaccgtagagaccggaaagatcacgggattgctggggccatcgggcagcggcaagacaactttgatgcgcgcgattgtgggagtgcaaaacttcgacggcacccttgaggtgtttgatcagcccgcaggtgctgcctctctgcgcgggaaaatcggctatgtcacccaaaacgccagcgtatatcacgatctgtcggtgatagaaaacctcaagtatttcggggctctggctaaaggaacctccactccacgcaccccggaaaagattctggaggtcttagacatcgcagatcttgctcaacgccaagtatcaacactatctggtgggcagcgcggccgagtctcccttggatgtgcgcttattgcctcaccagaactcttggtgatggatgagccaaccgtgggtttggatcccattacccggcaagcactgtgggaagagttcaccaccatcgcaaaagcaggtgctggagtggttatctccagtcacgtgttggaggaagccgcgcggtgcgacaacctcattttgttgcgtgatggtcggatcatctggaggggaacacccacacgccttctagaagatacaggcaaaagctcatacgaagatgctttcttggctgccattgacggggtaaggtcatgaaccctcactatctgcttgccacggtcaaacgagtcctgctgcagctgaaagccgataaacgttccatcgcgctgattcttctagcacccgtggcgttgatgtcgctgttttattacatgtattcctccacaccggcaggcacccagctgtttaagaccatttccacggtcatgatcgcagtgttccccttgatgctcatgtttttgatgacgtcggtgacgatgcaaagagaacgcaacgctggaacgctcgagcgcttgtggaccacgaacattcaccgcgttgatttgatcggtggctacggggtggccttcggcatcatggcggtggcgcaatctttgctcatggtgctcacccttcggtatctcctgggtgtggaaaccgaatcggagtggtggatttctacgctcattgctgcgatcaccggtcttatcggagtgtctcttggcctgttgagctctgcgtttgccagcactgagttccaagctatccaaacgctgccgttgcttattttgccccagttcctattgtgcggtttgctgatcccacgggatgatctgccggatgtgttgcgctgggtttctaatgtgttgccgctgtcctatgcagttgatgcagcgcttgaggcctcacggacgggaatcggacagcaagtagtggtcaacattgccatctgcgccgcgtttgccgtgagcttcctgctggtggcggcgctatcgatgccgagaatgacccgctagattactcttccagcgaggtgccaatcatcgacatcgatgtggccctcgcctgagcggctgcctggccacggtgagtgatgagcagctcgattaattgctcagagaccaacatcagcgcggcccgtgacgttcgggtgagctcatcttggaatgaggctgtcatcgggggaacgatcaaggacacatcagcggccacatcgatggcggaatgcgcaaaacatgtcatcgccataatggttgccccacctgcacgtgctgcttcgatggtcgcaagcgttgctttgctggcacctgaaccagaaatcgcgaagcagacagaaccttcacctaattgacgagccacaatctgctccgacatggaatcagaatgcacttcagctgaacgacccatcgagttcaaacgctgcgaaaaatccaaacccaacggcgcggacagcccatgagaggccacgagtacccggcgcgcagaatccagcccctcaatacagcgcgtgagatcatcttcggtcaacgcagaggccaccgtgcccaacgacgcttgaaaatcagagatccccgcctgcaaatgaccaagcaacgaggagcttaacgctccttcaaccatgcttctcgacgcgccctgcgccagtgccagttcctgcgccagggcgacgcgcagctgcgggaatccgtcgtagcctaaggactgggcggtgcggatgacggtggcacgcccaacccccacgcgatctgcaaggccctgagcggtcagttcgacgatgctgggggcgtcgacaagcatgacttcggcgactttgcgctgattaggctgcagcgatggcgcaagcgtggtgatgcggatgcttggtggagcgtcagttgcttggtgccacgacacggtcactagcccccttcatgatgcggcggcggatggtgccggagatgagatcgacgatcatcgttgcgacaaccacgacgatgagcagcatgcccacggtgtcccactgcctgtagttggtgtaattggcaagcatactaccgataccacctgcaccaacgatgcccaataccgcagaggtacggatgttgatctcaaagcggtacagggcaaaagatgcaatggatggcgcaacctgtggccacaacgcccaccgcagaacctccggcgtagttccacccgctgcacgcactgcctctgacgggccggtgggagtggactcaatggcttcataggtccactttgcctgttgtccaataccggagatacccaatgcgagcgcaccagtaaaaggagttaggccggtgacagttagcaaaataattgcgataaccacttcggggaacgcacgaatcaccgcgaacacgaaccgtaaaacggtacgcagccaataaggtcccaccccgcgggcagccaacattcccagagggacagagaccaccacgcataaaatggcacccaaccacgccatggcgatggaacgccacatttcctggacggcgcggccaaacttcgaccaatcgggatcgctaaacatcagctctaagtaatgccacacctgcgcgggcatctgcggaagctcattccactcgatcttgagcgtgccggtagctataaggacaatcagcgcagcgacaattgcaacgatattgcgcgccagtttgttggggcgcgccgggggagagctgggggccggtactgtgcggtgagaggttaaggtgctcataccagcctctttcgaagtgcgttggagattacttcaatgacaatcaccacgatgaggatttccagaatgatcacggaaacatccgcgtaggcatagaaagctcggcgttcatcaagcagcctgccgatgccacctgcgcccacgatgccaaggatggcggagatgcgtacattcagctctagggtgtagagccattggttggcaaagagcggcatgacttcaggaagcgcggagactcggttgatttggaactgtgatccacctgctgcgcgtcctgcttccatatagggatgctcagtggaatcaatggcctcagagacaagcttgaccacgatgcccaggttgaacagaaacagcgtcaaaatgccaggtaatgcgccgacaccaaccatggcgaccaagatggtggcatacaccaagtcggggacagagcgcaccacgttaatgatggtgcggacaatgccacgaccaatcgcactggtgttggttgcctgcgctgcccacaacgtcaaaggcaccgatacggcagcagacaagacagctccaacaagcgccatctgcagggtttccaacatgggaagccacgtacgaggcaagaacgcaaagttgggctgcagcatttgcaggagtttgttggcaccattgcgccaattcgcagcaatggaagcgaaatcaagctcaatgccacctagcgctggggttgctgttgccacggtgaagacaacgatggcgccgatgatgagataggtctttaccccagcccgaggcttttgtgggataagtggagaagaaggcgtggtcatgcgcgatcacctagcaggtctttagcctggatggggcgaccatagatagcttcaaagtctttatcggtggcctcagagataggaccgtcatagaccagcttgccggcacgcaaacccacaagccttgtggtgtattgacgagccaaatcaatcaagtgcaagttcaccaacacggtgaggccttccacgttgttgatgttttctagatcgcgcatcacggaatgcgcggttggcggatcaaggcttgccacaggctcatctgccagcatgacagacggatcttgcgataaggcgcgcgcaatagcaacgcgctgtttctgtccacccgacaaagcaccagctcgggtccacactttgtccaaaatgcccacggactccaacgcgtgaaaagcaatctgcttgtcgtgctccgtgggaaacccgaggaggttacgccaccacgctgtgtgcgcgaagcggcccaccaaaacattctggaacacactgctgcgttccgacaggttgaacccctggaaaatcatgccgatctgcccacgggcatcacgcagtgctttccccttcaaggtgttgatctgatgcggccccaccgtcacggtgccttccgtagcgcggacaagaccgttgatcgtgcgaatcagcgtggatttacccgatcctgacagacccacgatggcaaccatctcaccgggattgatggtgagggaaacatcatcgagggctttcgtcccattgggatacgtcaccgacacatggtcgaagttgatagcccaggagttggtggtagccgaagcatcagaattcatatgcgcacaccttgagtattggaaacagggaaattagttggagaacttcttcaggatctcgccgtaacgagtgatttcatcctgtgcggtatcagcagtccagtcagatagaccaaccatgtcgaacatgacatccttggcttcctcggaggaatctgcgtaatcatccatcaactcggtgagcttttccaccaggtcggatggaagggacttggacgctgcgacgccaccgttagggatcatctcggtgtaggcaaacgctacgacatcctcagctgcgttaggagcctcagacagcacggtggaacgcgcatcccagaaaccgaaggacacttccgcgtcaccgttcaggacagacagcacagcgttgttgttgccctctactggaacctgaacaaaagcggaatcggtatccatgcccagatcctgcatagcgacgatagggtactggtaacccgcaggagaggttgcagcctgcagcgctaccttgtcaccggactcgatcttttccagcgcatcaagagctgctgggccctcaccggtagcagcctggccctcagtttcaataccgttgcagtaaagcatgtctacatcggacgcagcataagacgcagccactggggcatcgtcgcagtacttatcaggattgttggtgtacgccacagcagagtacgaggtggcaccgaaacgcacatcacgcagaatcagctgcgcatcgtactgctcaatcgcgttatacagggaacccgcatcagtgatgatcacctgagcctgatcagcacccaaagcctcaacggttgcagcgtaatcagacgccaccacaccattgacctcaataccaaggttctcagacaggtaatcagtcaaaggagccaacgcttcagccaaatcctcaccctcagtagaaggaacaagagacaaagtaatggactcaggccactggcttgcagcatccgaagaagaagacgcagatgatgaggaagaagactcatcggaagaggaacaaccaactagagcaagggtagagatcgcaagcgtagaaacagcaacacgcatggacttggatggcttagagagcttgaacatgagatctttaaaaacctttcagcgacatgagacaagaaagttaagaagatgagacccgggaagaaacccaggcaaggagagggagatcagcgatagaatctccacgcatggagaccttcgcttcagaaatggttgctgtagctccaaccagagccgtatctgcacctaactgcgctgcaggactcagatcgaattcataaatatcgcccaccgcaagcaccggaccatcaagctgcaaatcagaaatgatcgaaatcaaccctgcaggcttacccaccacaaaatgcaactgatcaaacaaatcagcaacaccccactgacgcagcaaatcatgcacgccattttccggggcattggtagctaaaaccaaccgagcatgacctttcaacgaggacaaaatatccttaataccccgcacatgctcaacaggcgctaaatccgaaccaagcaacttccggctctcgccataagcgacagacatcgtgccatcatcaatccccaattccgacgccaacttagccacaatgtcatacccatcacggtaaatactctgaccatcgtcatagcgccgaagctccctgcgcacacgctccagaaagtccttggaaccctccggtgcaacacacaatgcatacgcaaggacagggccatggccaatggcaagcgtgccatcgaaatcaaaaacaatactgggtgtcacaaaaagatccttgaatcgggaagaaatggacgatgcgttcatcataaaagttattcatgaacacaacgtccaaccttgagtgaacgatcaatgacacctacatgaacacttgcccccagcccaaccccacagctgcaaaagcgcgccgggccatctcctaattgacagagatggcccggcgcgcagtgagatcaggtttagctagatccaaccattgtccaaccatggcgagttgcctgatcaaagaactcgcgttcatgaacagaggcgctcaagaatgctcgagcagcatcgacgcgttgttcagcacccgcattttctagagccttttctagacgtgcgatagccgcacgggttccagcgatgaattcttcaccggagtaagtgttgagccagtccttgtaggggtgctcgtcgtggttttgttcagccagcatcaatccgatctctgcgtagagccagtagcacggcagtacggccgccacaccgcagacgtagtcctcagtgtaggtgcgtgcgatgaggaagtcggtataggccatcgtgatgtgtgatggtgcggagacttctttccctgccatataagagcggtgcagttcggcttccacgaccaggcattctgcagcgctttgagcccattcgatttgtgcgtgtgaatcaggtgcgatcgaagagagtcgtgccaatgctcgggaatattgggcgaggtattgggcgtcttggtcgatgtagaaatcgaactctgggcgccggagggtgccgtcgccaagcatggtgatgaagtcagaactgttgatgcccgcgatgatatcgccacttgcctcccacagcgcgcgcgtgaaaggcccggcaggttcgatgcgtggagctgggctttttaccgtggagggtgtggtgaaacttgccgcggtggcgccgtctaggcgcggagcccgaaggtgtgcccagggagtggtttccgccgcgtgggtcatgcgtcgtgccaggtgaccgtggtcgacagggccgtttccagtacctacagccaagtgatcggcgtggcggagcgcctcgttgagccaacgcgtggaccactcgagggctttttccacgctttcgccggcggcgatcttggtggcaagtgacgcagagagcgaacagcctgtgccatgggagttggtggtgttgacacgcaggttttccacctggaacaccgagccgtcggggcgcacgacagcgttatcagcaagcgcgccagtcagatgtccacccttgacaatgacgatggtgtcatgagtccgcgcaaatccctgagcctgagcaatggcctcatccatggtgatggcaggagcactgtcgcacaacacggcaagttcggggatattcggggtgaccacatcgacgtgcacggccaggcggcgcagcgattcttcagcgctcgcatccagtaggcgatcaccgctggtggcgatcatgacgggatcaagcaccacgggaccgtgctcgtgggaaccaagccatgaagccaccagatcgacggtgtcggcagagcccaacatgccgagcttgatggcatcgacggtgacatcggaaaagaccgcttccagctgttcttccaaaaaggtcaagggtggggtgtggatcgtgttgacgccgtgggtgttttgcgcgaccagcgaggtcacaacgcacatgccgtagccgccacctgctgcaatggacttcagatcagcctgaatacctgcaccacctgtgggatcagtgcctgcaatagacaacacacgtggggcagaaggcgaattcacgaaggctccttggagttctgtttgagagagttcagtttgagtttcaggcgagaaagtaggttgaaaagcagtccgcaggcgagttgccgcagctgctggattggcggcggtcatgatttcagagaccacgcacagaccgtcgatgggcgtagcagcgagttcggccgcgttgcgtagaccaacgcctccaatagctactgatgcgatgccgtggtcttgagctacagcggcgatctcagcgatgccctccacacccaatgcgggtgccgcatctggtttggtcgcagtagaggccaccggaccaatgccaatcacatcgggcaatgccacaccagtctcggcgcactgcgcgatcacagcatgcaattgatccaggttttcaatgctcaaacccaattcaagatgagctggaagcagctcccgtgcttgcgtataaggtgtatcgccttgaccaatgtgcaggtgaagacccagctcaacggcgatatctaagtaatcgttgacaacaagcgccaccccgcgagcatcgcagagttctttcagctcctttgctgccgcacgaacatcttccacgcctgagttcttatcgcgcagctgcaccacagaaactccgccggaaattgcgctgtcaacaattccagctactttttctggcccgccacccaaaacgggatcggtgaccagatacaaagaaaaatcagtcacgtacttttcaggcctctcgcacatcaaccaacgaggccacagcctgggcatccacgtcataaagcgcatcaataaacgccaccgcaaagctgcctggcgccgatgccttctgtgctgcaatctggccagcagcacccacatgggcatgcgcagccaacacagcatcgtgcgcggaaatatctgagtcaaccgtggcgcctagatatgcagctgtcagcgcgcccaaagagcatccagtgccaatcaccagctgcaacatcggatcccccgaacgcaaccacgtcacccgatccgcagacacaatcaagtcctccgcaccagagacagccacgacgccaccagtgcgcttggccaacaattgcgccgcctccaacgccacttccacggaatcggtcgcgtctacgccgcgcccaccggcaccgagccccgcaagcgccacgacctctgaggcgtttccacgaattgcggcaggctgcttatcgacgattccctccgcatacttggtcctctccgacaacccacccacagcaactgggtctaacacccatggtgtgccagcttttcgtgcaccctcaatggccttggtcatgccttggtattgctccgcagaaggagttcccgcattgatgagcactccattggccacagcggcgaattctgccgattcagctggagtatccaccatcgcaggggtcgcacccgcggcaagcaacacattggccgtgaattgcatgaccacagagttggtcaaacactgaacaaggggagtgttttgtcgaacaagagttaaagaatccaaaaacgagttagccacgttaaggccatcccttcgctagtacgagctagagcaggttcaacgggtgttttctcagcctccggaatttttccatccggttggcaccccgtgcctagtattcagcctagcaaagcggaattcacctgccgtacatcacacgtccaagaatgcgggcagaatcaaaaaagcgtgactcccgagaatgtggggagtcacgctttttaactacgcagcgtcgtaagaaaattactttccgctgaaacgctggttgtcgcgcagctcgattggaagatcagaagatgcttcctcaagctcgtgagcgaacttggacagcgtggtgcgtgagtggagctgctggcgggtggttgccaggttccaacgcttgcgggacagtgcgttcaggccccagctgattgcggagacgaaacggttgcggaagccaaccaggaacatgatgtgaacagccaaccacagaacccaaccgatgaagccggtgacctcaaccttgcccatcttcaccactgcggagaagcgggaaatggtagccatggagcccttgtcgaagtaatcgaaagcttcgcgctcggtgttggagcggccttcaacctcagcttcgatctgctcagcaacgtactcaccactctggattgctacctgagcaacaccagggaggttgttgtagttcatcatgtcgccaacaacgaagacgttcttctgatcgccaacagacaggtcatcgttaaccatgacgcggcctgcgcggtcggtctcaacaccggtctgctctgcgacgagcttgcccagtggggatgccgcaacaccagcggaccaaatcttgcagaaagattcgatggtgtgctcttcgccgtccttggtcttgtaggtgaccgaggtagcgtcaacgttggtgaccatagcgttcaggcgaacgttgacacccatcttttccagggtgcgctgtgcgttgcggcctaggcgcttaccgaatggaggaagaacctgtggagcaccatcaagcaggatgatctttgcggagttggtgttgaagttcttgtactcaccagcaagggtgcggtgagccatctcagccaactggccagcaagctcaacaccggttgggccagcgccaacaacgacgaaggtgagcaggcgttcgcgctcagctggatcctcgcagatctcagcgcgctcgaaagcaccgatgatgcgtgcacgaatctccagtgcatcgtcgatggacttcatgccaggtgcgaactcagcgaagtgatcattgccgaagtaggactgacctgcgccagcaccaacgaccaaggaatcgtactcaaaaacgcgggtgaactcgcccagggaggcggtcacagtctgggactcgacgttgatgtcggtgacttcgcccttgatgacgttgacgttttcctgggagcccaggatctgtcgagtggaaggtgcgatttcaccggaggagaggataccggttgccacttggtacagcagtggctggaagaggtggtggttggtgcggtcaatcagagtgacatcgacgtctgccttggccaggttcttggcagcaaaaaggccaccaaaaccagaaccgatgacgacgacgtggtgacggccgccttcggggcgggttgggttaactgacatatttgtcaaagtctcctgatcgtggatcttaaagcttgtgcggtctgccgtgttacgcgtgcagccgtttaagcgttgtcgtgttgagcacgtgtacgcgttaaacaatagtacttcctacggaaacaaacaggatcgggtcatgcttttctgtccgttcggagaaaatcttgcgaaattcgcgcccactttgaataagtatgcacgttggtatggcatatgtcacgtcaaatgtcagaactttttatccgtgctggattaaaggcgaaatatcgccggattaaacccacttcgacgcgccttcactcccgaatcgtcatgcgcacgtacactacttttagcagttaacccgccgaactttcttgattaagtattcattgagcgttcttggcataaatcccactggaggtgcatcaaacgtatggcagaggcacgtttgcgccatcttgaacccattgatgtggaagagtggcctggggtggcgtcagtgcccaacctagcgtttgctggtgcacgcgcacggcaagcagaatatcgatttgccaaggcctgcagcaacgcaggtttagttctgctaggaaatgacccggatctcattattgatcatgaggaattattctcacgtttggccgcatcgggctggctggggctcgctgagagctacatggcaggcgagtggcgcagcgagaggcttgccgacgtcttgaccgctttgttgggaactgggtttaaaccccgcggcaaactatctggatcgttcaccctgccagggcaagctgtggatgccggaggcgcactacccaatgaactcattcgtttaagttcaggtgatggcatgagcgcatttggtggagtttttgcctccggtgttccaaccactttacgtaccgcagtgaaaagccatgtgccgggagctggtcgcaatagggagcccgcatctcactttgtggatatcaccaagatctcggagcctgtggccgtggagcgtgaagacctcggcgaggctcagcgccgagcagcgtcctttttgcttgacggcgccaaagttaaagccggaagccatgtgttggagtttcccagcagtggtggagctttagctattttggctgctcgacgccagggaactgttgacgctttaacggctgatcccgcgcaagtttcaagcctggaggagacgtttgtgctcgccggtgtggaggaggatattcacatcgaggtcattccccaggcgattccctcgccacgcgaatggggtggcgcctacgattcgatagtcgccatggagaagctagaagtggtgggcaagcacggttccaagcggtttattaaagctatcgacagaatgctcaccaccggcggcaacgtagccatgcaatccttggtagctactgaccaatggagtcctgtgtgttctgaagcgatttctttgctcaaggcctatatttggcctgcgctgcattacccaactgttgatgaagttcatcagcttgttgatagggattcttctctgcgcgtggtgaaggaaacacactttgcgggccattacctaaaaagcgtgcagttgcaacgtgaagtgtttgaaggccagatacgcgaagcggcggcagatggctttgatgccgtctaccgccgcatgtgggtgtatcactacgcgcttattgaagccctgttacgcctgggatgtctcaatgcagtgcaatttgcgttgacgacaagaaacagaagggggcgtcgataagcaaaaatcttttagacctctcggaggtcgtggtttttgttttccttcatcgtcagcaccgcaacaaaggtaattgcggtgacgatgatgaggtaatagccgacgtacgccactgaaaactcggacaccagccacgttgcgatgaacggtgcaatagctgcaccgaggatcgaggagacattgtaggcgattccggagcccgtgtagcggacgttggtggggaagagctccggcaaaattgccgacatgggtccaaagatcagacccatgatgctcatgcccacgaacaagaagatgaacacggtggtcttggtggcggtctctggatcgagaagcagattaaacgtcagaccaaagccgagaagcagcacagaagccaaggtcagggtgtttttacgaccccacacatcagccaaccagcctgacacagggatcatgatggcgaagaacacgatggtggccagctgcaactgcaagaactcaaagtacggaatagacaggccgtttccggtgctgcgattaccgatgccatacgacagaatccacgtggtaaccaggtagaacaaggtataagtggacagcatgatcaaagtagcctgcacaacagggccaggggaagtcttgaacagctccttgagcggagacttcaccttcttgccctgatcaacagcctgcttgaacactggagtttcctccagtgagaaacgcacccacaggccaactgcgatcatgatcgccgaagacaggaatggcagacgccaaccccaggtcatgaacgcgccgtgaagatcgccgtcctgatgggcaagcacaccgaccagaatgagcatgaaaccattggccaagaagaaaccaaacggtgcacccagctgtggccacattgcagcacgagcgcggtgagtgttttccgcgttttcaccagccagcaacgcagcgccagaccattcaccgccaaggcccaggccctggcagaaacgcatgagcgccaacagcgccggtgcaatgattccgacctgaccataagtaggcagcaggccgatcaagatggtggcaatgcccatggtcagcagtgaaccgatcaaggtagctttgcgtcccacacggtcaccgaagtgcccgaaaatgattgaaccgagtggacgagcaacgaacgcaagaccaaaggtggcaaacgatgccaacaggttcacggttgggttgtcattggcagggaaaaacagacttgggaaaacaacgacagctgccgcagcgtacgcataaaaatcgtagaactcgatggttgtgccgatggtggaggctgctgcaacccgacgtttagttttcttgtcaatcactagggttgccgtctgcccacctggatcagaaggattcaactccgtggagtgatcagttgtggtcacgagttatcgcctcacacaataatagattccaataattacccttgcgatgtttccacaggagattattagagtcaatcccatacaatgagatgttaggcgctatggtttcatatattgagattttgggaggggagtctgtgatggagcttggaacagttgtctttgttggatgatcgcgggaaaagtatgggtagatctttggaatttttggtagaaattggaaaaagtgctgctcacaggatttgcgagcagcactttcacgggtgaaaaattacttagaaggctccactggaggcagggtagaccatgggaagttaatccacttatcagtctcacgccacacatactccggcttaaacacactgtttggcttgtgatagatcactgcagtgcgcacttcgacaacttggtcacccaggaagtccctgaccaactcaagagtctttccggtatccgcgacatcgtcagcgacgagcacacgcattcccgagagatcaacagcttttggagttggaggcagcatcattggctcctccaagtgctctccaatatcggtgtagaactccacattgatcaccgatacattcttgatacccagcgcataaccaagtgcgccaccgattagaagaccaccacgcgcaatggacagcacgcaatctggctggtagtcatcaataatttcttgggccagctcccgcattgctgttccgaacatctcataggtcagaatctcgcgttcctctgtcatgtctacatatcctagtcaatgatgcttcaacgttctgcaatgagatgaatgctcacttgatttctagggaagtatatatagaatcgttaacgcccaagcaacgaaaaacttggcgcaaccacttccatttcgaaggggagtagttccacacaaaggcgatctgactcgtttttgtttgaggtatgttcgacatactggagcaagttcaccttgcacccggcataccacctgaacaaggccttaaaaaggggctttatcggttcaggcgagcgagaccttcggcgttcacacttcgccggggtctattttttatgcccaggcacggctcataggagaaccatgccctttctacaaatctctctgctttccatcggtgtcgccgccgatgcgtttgcttgttccgttgtccgcggcaccgccattcaagtcaaccttttcaaacgcgcacttgttctcgcgggcatctttggtgtcttccaagcggcaatgcctttaatcggctggttcattggccgtttctttgctggaatcaccttcatcgctgaaattgatcactggatcgcttttgcactattgggtattgtcggcaccaaaatgatctgggatgccttccaacctgaagatgatgaaaccattgtcgatgacggccgcgttcaatttagaccagcaattatcctggggctagccaccagcattgacgcattagccgtaggcatgggcctggcattcgtggaagtttccatcctcaaagtggcactgtccatgggcagcatcaccttcgcactttcgcttgctggcgcctggatcggacaccatggtggaggaaagtttggcaagtgggctacgattcttggcggaataatcttgatcggaatcggcgcaaacatcgtctacgaacacctcagcgcgtaaccctcggcgcattatcctcagacagcttttagcgcaaacaaggagcatcattgaaacgggtcgttgaagcgtgggatagatttcaaatcccactgtatatcacggctcttatcgccggagcactggtgggtttgcagtggccaggctctacagggggtttcgaaagcgccattaacccagcgttaatggcgctgctttatgccacttttctcggtattccgatcactcggattggtgcagcgctgaaagatctgagatttctcatagtgctcatgtccgtcaattttgttgcagtgcctctggtggcttttgcgttgagcagattcattgcgggtgatgaggcgcttctaatcggatttttactggtgattctcgcgccgtgcattgattacgtcattgtctttgctggtttggccagggccgcccaagacaagctccttgccgccacgccaatattaatgcttgtccaaatcctgctgatccccgtcttcctggctgtttttgtgggttcagatgcccttggctcaatctctttcggcccatttgtagaagcatttttcctcctgattctcattccacttgttgctgctgcgggaactcagcaagtggcaagaaagtggcaggtaggacgtacaattatggctgctgcagaagcaatcatggtgcctttaatgatgctgacgttgttcgctgtcatcgcatcgcaagtggaagctgtgagtggtcaattcaccgatatcgccacagtagtgccactatatgtcgcctttttgatggtgatgattccaattggtggcgggatatccaaactcggtggcttaggtttcaaagagcaacgagccatcgtttttagcggagcaacccgtaactctttggtcgttttacctttagcgttagcacttcccgcaggcctggaaatagcggccgtcgtagttgtcactcaaaccctcgtggaactgattggcatggttgtctacgtgcgcatcatccctttaattttccatgaaaagcagacatacaggaaactttcaggcataggggagtcatgaaacagaacggcaagctaaggtgacatagtcacttaaactaaacaagaagggtggaggacccaagcacgtgagtctttcaaacaaagctaaaggaatcgttgcagtaatcatcgtcgcctggatcgtcgcgatggctggcatggtcgcatacgcgtcaagcaataatgctgataagacatttccaactgcaggtgcgctagaacaaaccgtcgcagcatttgataggcaaggccttcaggtctctgcagtcgcactggcagacatctacggcgatgaatacgtctccgcggcgattctgtgcgaaggaactccaaccgcaacactcgagcagtcactgggcgtagacctgtctgagctgaacctggacgagtctggtgttccttcgggcgtgtcctacttggctctgtccaatcaggatggggaagttgtctacgacaagattgatcgtgccaacgttgatctctgcgcaacgccactcaatggtgctttcagcgcttattcattgatgccagttgccaaggttggcgagaactcctgggcgatcgccgcttagggttttaagggtcaatccgccacacatatagcccgagacgataatgaacgttatccgatcgggctttttgctgcctatttacggggagagttttgtcaatgtgacgttaatgaggtgagtatggatatgggttgaaaacagggaaaaacggctaaaagtgcgagaaatgggctattcgaacaaaaacagcggtttcaccaaggtttcgtcacattcgcacattcgtcacaagggcggttacgtcacggaggtcaatttgtcataggactcgattcgtcacagccgtctttacgtcactggagccattacgtcacaccgggacctcaaattcgctcaaacgatattccgcacccggcaactgtcggtcgggtggcgccacaagagttgcctcgcgaagaatctaaaaagctctgccacaaaatttggaagcaacgattcctgccggaggaaaattctcaagcggcggacaaggtgcagagcgcaatgatgcgtagaaattttccatgcagaggaaagccgataatggggcagaaccccttcccgccaaaatgacataatgtacattatcggacaattatccatatctggccatgtcgcaggccgctggtaagtttaagcccatgacttcaacgctcgccgaatcaacacttacatcccttaaagaacttgaggatccaaagatcctttccgtcaatgaacgccacggcgatgatcacgcagtgaacctcaccaagcttcgcgccgttgccaaagagctgaaaaagaaccagccgctggctcgtgagctttgggcaaccgacgatacagccgcacgtttggtggcgttgcttatttgccgacccaaggaatttgatcagtctgaactcgactcgatgatccatgaggctcgcacgccgaaggttcttgattggttgatcaattatgtggtcaagaagaatcctcattggaacgatctccgtgtgctctggcttgaagatcccgccgagaatgttgcggccgccggctgggctctcaacactcatgccgttatcacaaagccggacgcattggacgattccgaaatccttgacaccattgaagctcagatgaaaactgccgagcctcgcgtacagtggtcaatgaatgaatgtttggcgcaaatcggcatccatcgtccagagcttcgtgatcgtgccattgccattggtgagcgcctggaagttctcaaagattatccgacccctccaaattgcacctcgccttttgctccgatttggatcgaagagatggttcgcaggaaaaaataaccgacctgttccctatctttatttcgtcactctgacattaaacctgataatttgtgacccaccaaaacaccagctacccttatgttttcccccgcctaaggaccgccttgttccaagtcgcctgaaaggcgccagcaaagctttcgcgcttggtggctaggcgcgtcgacaagcgcctaaatttttctagactacccagattaagtgagattctttcgtgtcttcgacaacttcgacaacttcggccacccgacaagagccgttgagcccgacgggtgtgcttgcctcgtttaggttcgcgtttagtagcccgcggaggtttcgcaccgaggttttagctggcctcgtggtggcgctcgcgctgattccggagtcgattgcgttttccgtattagctggcgtggatcctaagatgggtctttttgcgtcgtgcaccatggcaatgaccattgcgcttacaggtggacgccctgcgatgatttccgcggcgacaggcgctgtggcgctggtgattgcaccggtggttcgggatcatggcgtggaatatttcctggccacggtaattttggcgggcattattcagattgcgttgtcgttgctgggtgtagccaagctgatgcggttcattccgcgttccgttatgctcggatttgttaatgcgctggcgtgcttggtgttttttgcgcagctgccgcacctgatcgatgttccgtggatggtgtatccgctgttcgcgctgggtattggcatcatgctgttttggccgaagctgacctcggtgattccggctccgctgattgttatcgtggccttgactgcgatcgtgtgggttttcggaatcaacattccaaacgtctctgaccagggcgaactcccctcttccctaccagaattcctcattcccaacgttccgcttactcttgagactctaaaaattattgggccgtatgcgcttggaatgtcgcttgttgggttgatggaatcgctgctgaccgccaagctggtcgatgatattacggaggttcactccaataaatcccgcgaagctgcaggtcagggcatcgcaaacattatcaccgcgtttttgggcggcatgggtggctgcgcgatgatcggccagaccatgatcaacgtgaaaaactcaggagcccgcactcgcctatccaccttcttggccggcggcttcctgctgctcctggtggttttgctgggcgatgtcgtgggcaaaatccccatggcggcgctcgtggcagtcatgattatcgtctccatcgacaccgccgactggcattcgctgaacccgcgcaccctcaaattcatgccgctgagtgaaacgatcgtcatgtttataacgatcatcgcgaccctcgtcaccggaaacctggcgatcggcgtcatcctcggagtgctcaccgccatggtcatgtttgctcgccgcgtggcccacctcgtgtctgtggagcgcaccaccgacaacaacatcagcacctataccgtcaagggccagctattttgggcgtcctcgaacgatatggtgtactccttcgactactccgacgaggccgagcagatcatcatcgatctcaccgccgcagaaatctgggacgcctccacggtagccacgctggacagcatcatccacaaatacgccgcgcgcggcaagagcgtggagatcatcgggctcgacggccccagccgcgataggcttgagcgcctatcaggcaagctgggctaaaaatttgcttatcgacgcgcccctccacctgcgcaatccttagttgcagggaaatttctcaccttgccaaaggaggccaggtgagattcccttaagcaggttcaacagaagctgcgaactgtcctgatccatcatcaagccagctaattactccagatgtgaactgttgagtccaaccatttgttgttgcttcttcaggcccagttgggagacccactgccgcggatagtccgccttcgccgatccaggtttcaccgatcatgccgaccagtgcttgtgcaccaccttctgcagagttaacaatgtagccttcagggaacgtcaccaatgactcaccattcgggccttcttccacggattccggggtactgaatcctgcagcatttgcagcggtgacgacggcagttgggatgctgatggtggacccatcggcgctttctacttcagtggtgtctcctccagcagagtcagacccggagtcggatccagaggttccggaaggctctgtggtggatgcgctggaagtgccggtggcatcgttaattgcagatcccgcggcggaggttgcagagttggcagcatctgttgcgctatccacagcatcttctgcgtttgagcaagacgcaacaccaagtgacagtgcgacggcagcggtgcctgcgaaaatgcgagtacgcagtttcttgtttggaagagtgctcacgtgcattggcctttctcgaattgggtatcaacaaagtccattgtgggtaaatcacttgaggaaattccaccactcggtgtgatctttaatacatagaaacagatctgttacccttatgaaatctaagaatcgcgccacctgcataaacaaaaactccccactaccgcctgactaaggcgataatggggagtttgaaactcacaggtgtcttaagtgttgcgttgtttttctacttcatcgcgagttttatacgcggtccacagttgccaaccactcactgcaatgagcaagagcccaatgaggacgaagatccacatggattcccacagtacaaagccggtgaatccgatgagcacgatgagtctgaaccacagagctgggatcatccgtgatgccatcatggtttatttctccaatacgattcggacgttgatctcgccggtctcattgatctttgcggcgatgaactctggggtttctacaccgaagtcgaggcggttgatttcgatatcggaagccacgataacttggtcaccagtacgaagtacatcaaaggtaggctccacagccttggtttcaccgtggatggtcaactcgcctgggatgacaacctgagcaatggatccggtgtctgggagcgcagaaagatcaacggaatcggtaacctcaaaggttgcttctgggtactgatcggtgtggaagagcttagtgcgcacgttgatgtcgcgcttttcctgatcggtggtgatgtgagtcatgttgacggtaatcagaccagagatcagggagttatcctcgatgaccacttcgccagtgacaccagtggttgagccggaggtgatcttttcttcgcctggcaggatctcagcgaaggtgaatccagctgaggtggtgtttggaatactccctggggcaacatcccaggtgccgttcatgtcggtggacgcaggtgctgcgccatcagcctggattccttcggttttcacaccaggtcccatgatgagctggtacacgacaggtcccactgcaatagatgccaaaccaacgatcaagatgacaaagatgacgataatcaatgtccggaacttgatcagtgggctctccgcacgactcgcgccgctagatttcttggaatcgtttccctgcatgttgctcattacctcaacttctcaatattccgagctaattccaccatctcctggcacagcttcgcgatatcgcgagcctcttcctcttcattaacagcggttgcgatatcttcggcggcgcaccggagctcaaagagcgaatctttgagttcgcttgcccgatctggggacataatcactgcttctgcgggaatacttgtgccagagacattgttgcgttgttcgtaggctcgttgcctacaagcttggctgcagtatttccttggacgtcccctgcctgttgaggcgacgtctttaccgcaccaggagcactttgtagtctgctggtttggtcttaatttctgcacctttaacaccttagtcgattgcctcccatacaacgattcgggggttttggctatacttataggtctgatcacatttcaagggcagctgttgtgactggcagcgtgtcgttttatttgcacactagcaggtaaactgtgtgagacgaattcttttgcggcaacttggaggccgcattctagtaggcaaaggactgatacctagatggcagatcgcgttcttcgtggcagccgcatgggcgccgtgagctatgagacggatagggaccacgatctggctcctcgccagctcgtgaagtacaagaccgcagacggggaaatctatgaggttcccttcgctgatgatgcggaaatccccgaggagtggatgtgcaagaacggtaagctaggcatcctcatggaaggtgagggagtcgagtccaagccggtcaagcctccacgtactcactgggatatgttgcgtgagcgtcgctcaattgaagagctggatgtgctgctggaagagcgcatcgaggcacttcgtaagcgtcgtcgcaatgcagcgaaactgctgaaggctcagcaagaggctgaagaagcagaaaaggcagctgaagaggtttaatcttcctgcctaagttagaaaaactcggtgtgattttcacaccgagtttttctatttgcacgtgaggcatttattgctcgtctaagacctcgaaaacctcttagaagcgcctctgcggaggtatgacttttgatgtgtggagccaaaacctaagcccaatcaaaccacactgcccacggacctcaacaatcggttccgtgggcagtgtgctttggtttcactaaccggcaagcagtttagagccaggtgttgcgctttttgaagtgcttccactcatagttcagcaggccgaccatttccttggacagttccttggcctggccaccgcggtgcttgaggccccacttggttacctcgagcagggaatccttgacaaagctgccgtccagcttggattcgccgatctcacgctcggtgaaagtgatgggaacttcacgaacatcgaatccggcttcaactgcacggtaggcaatctcaacttggaaaatgtacccagcgttggagagctcatcaagcggcagtgcttctagcacttcacgtcgaaaagcgcggtaccctgcggtcatatcggtcaagccggcgccgagcgcgacgctgatgtagacgttgccgcccttggacaagagccaacggttcttgggccagttgactacgcggccgcctggcacgtagcgcgagccgatgaccaggtcagcgccattggtgatctcagcgagcagcaggtgcagctgttctggtgcgtgggagccgtcggcgtccatttcgcacaggacctggtagtcgcgctccaggccccactggaagccagccatgtacgctgcgcacaggccgcctttgccttcgcggtggaggacaaaaatgtggtcgtcgtcagcagcaagcttgtctgcgcgctcgccggtgccgtctgggctgttgtcgtccacgatgagtacgtgaacgtcaggggttgcggtgcgcacgcgatccacgatgagtggaaggttttccagctcgttgtacgttggaataatcaccagcgtcgtagcatctactgcctcactgctcatggtgttgtcctcctcgtcccttcgggacgtttttattttacttttcgacgattagttgctgcctttttcgcaggcaccttcttaacccgaacttgtgcgggccgagcggaacctttcgcagactttgaacggctattcattcgaatggcgaatagtccagctaatacaccaatgataaccaacagtaattcaacatagaaaccaacccgcgctgcgatggtgacagtgtccttgagtggaatggattccgtcaaggtggcggcctcaaaaattcgggtgttttgggaaatgcttccatcagggttgacgatagccgaaacacccgatgtagctgcaacaaccaccgccctatcaaattcgatggcacgcatcctgctcattgctaattgctgatacgtcatgtccgtgaatccgaaggtggcgttgttggtgggcgtggtcaaaaattcagccccattggcgatggcgtcgcggccagcacggtcgaagatgacctcgtaacacgtcatcacgcccactgtcacagcgcggcctaagttcgcagcattcatctccactacgccggtgccatcaccgggctggaagtttccagcggaatcaacgtagggcgagaaaattctcaggaattcgcgaaacggcatgtattcaccaaacggctgcaagaacttcttattgtggtactccgcggcaccttcaacaggatcaaatacctgcatggtgttgcgtggaccaacctcatcgacggtgatcgtgcccaccaaaataggtgcctgaacatgttccactgctccatcgataatggctcttgcttgtgcatcggaaaatgggttgacgtctgaggaattctccggccagatcaccaaatccacttgttcatccagcttgagggtttcccgtgcgtgattcgccagcaccgcgcggcgctgtgcattgaagtccaatcccatccgaggcacattgccctgaattgcggctacttcgatgctttcatcgctcgtgccattgcggtcaacgtacagggatgacaccgcgccgatagcaatcacactcgcggtgatgattgcgccggccagtcgcttcttggaaataatcaccatggccacacccacggcagccagcaccgtggaaaaagtgacaaacgctaccccaccaagcgctgcgagattagccaacggaccgttaatttgaccccatgccaggcgaacccacgcgaatccatcaaatggccacgagcttcttagatactccacagccacatacatcgccggaaacaggagaaccttccagtccctccaacgcgcaatgagcacgccgaaagcaccaagagcaatggaataaagcgcctcgacaactgacaacgcgacataaggcagtgagccaacaaactcaccgatccacggcaacagctgcaaatatgtcaccaggccatggacaaaacctaaaagcatgccctgtacaacagttgggcccgtggacatctgttgcaaaaatgggactggctcattcttcttccgccgcttttggggaactcccagatcccacggcgcaagggagataaaaaataatgcagtgccaacaattcccgcgacaaaccagccgatcggttcattggaagcaaagacaaaaagcccgcccacagcagcaagggcgagccgaacaaacagtgtcacttatttctcaccgtcggattcatctttacctttggtgaaatcttcaggtttgagatcagaagtccaggcttggatctcgtcttcatcaatcacgatcggctcatttgatggttgttgcgcaccaccattgaatgccgctccgaagtttccgtaggatgcctgggtgcggtaaccattaacggcttcaaaaccacgcacacctaggttctcgatggcactgcgcatgcgcttggccaaaaccttgcggaacagcgccctggttggtgcaaaaatgaacaacaaaccgataatcgaagacacaaaccccggcatggccaccaaaatggcaccagctgcggtcagcccaatgtttccggcgatcgctcccgcacttccctggcccgaagcctgatgaatggcggcactcttactaatgcgacgaagctccacgccggctagaagaagtccaccgacgaagaacaatacgaggagacccaaagcccagccgaaaccgagccacatgacgacaccaatgaaggcgaggatctcaataatgaaatatgggattgctattgctgcaggcacatgccccaccatacctttcgacaaggaccaaatggctaatggatccctgtgacctagaaaactgttgggtggagacttcctggcagctgcagatgtgcaatgtgagtggtctagtttcctcaaacgtgcatttgagaccaaacgcaatactcgatgagagctgcttggtctgaaacgcacgtttctggggtcaggtcgtgcattattaggccaaacggagctgcagttttgaggttcttggtctggaaatcacctagcgccgaaacttagctcccggacctaaaattcgaccccctctagaatcgcttctccaggcttaaaagcgcgcaccccacaccagtggacatcgagagaatccgagcctttaaaacggcactcagacaagatgatctatgagccatcccgagtacttttccaggtttctaaaatagggcccgaaatggttgagacctgtgcgtcctggcacacgcggcgcttgggattcatgccaggtcaatggcgtacccttgtccgcccagctatcacgcaattccctaatgggatcaatgggaatgacatcatcatttttagagccccacaacagcactgggatttctggcgccacacgacccagcttttgcttcccaaactcagcgacaacaagtggcagatcgtccagaatgtctgccagcggcgtgccctgatgtgtccacccgcgggaagacgagtagccactggccaacaaggaacctcccgcgcagctggtgatatttttcagcacatcactgactccgcgttcatttaacaccgacatgatttcctcaaacatctctgaagagttcactgcaagtcccgcgatggcgtaggcaatcactccggtgagcaatccgccgtcgacagtgtccaagacgcggaagagatccactggtggagcgcccacgaccgctgcctttgggcggacatcaggtgcgtaatcctgcaattgtgcagcccagccagtggcgccgcctccttgggagaatccccacaggccaagcggtgcttccggtgaaaggccgagttgtctggaggcgaggacggcgtcgagaagcgatttagctgcagcgatggaatcgcaatagtattggacgccggttgcggggtcgcgggggtaatcgatgaacacaacgtcaagtccgtgagctagaaaccagaggatgacggggagttcgtaagcaatgattgcgtcgaagggtttgtcatagaatgcgttgagtccgatggcgcaggtgtgggagggatcgcagtgctgtgcgacgccttgggtggatggagccatggcgatcgcgggacgcgggccggttgtccaggggcgtgtggaaaagaggacagcgccggtcgcagtgatggctcgacctgcggaatcaccggtgatgtattcaaaacggtacgaactcgcggggttgggctcgccccgtgcgcccaaaactttcaagggtgcagcattgaccaacgtgccgtgttttagaccgggaactcgaacagctgcgccgaaatgtgggacatcgtcaaagccaggtttccgatcaggacgccgcgagagacccatgatgcgccgaaagactgcctcacttccctgctgcactagcggagacatcgtgcgccaccaggcatcacatgacccggcgcgcaagacccgtgtgtcgttgaggttggtgtagcccatatcggccacattagtgtgcgcgggttaggattacgcgcatgtcgagcgatgttgtttttcagtctgtttctgttaattctggtgtgtctgtgggtacggtttcttttcctgcggggcgtgtgggtgcgtctgagtgggagatgttggcggatgttgcggagtcgcagggggatggtgcgatttatgtgacgtcgttggcgcagtgtcaggtgcgtgggggttcgtattctcatgcggagccgtgtgcgacggtggtggcgactccggggcattttgttgcgctcgcgcgggagattgcgggcgcggtgcgccgcgagttgacggtggggttggatgctggtgacggtgcgattttaaggcagagctttgatgttggttttttgcttgtcgacgcctccttccacattcatatcaatggcgtgtctactgggcagtcggttgcgccggatgatgtagttgaggtggtgcgtggtttggctgatgcttcggagttgtccgtggaaagtgttgctgagttgtgtactcccgtggcaccggtttcattatctgaggcacaggggaatcctgcgcctattgggtggttggagcatgatggcgtggtgtcgttgggtgcgggtattccaggggggcgggtggaggctcgtttagcgcgttttattgcggtgattgaggcggagaccactattaccccatggaattcgttgatcattcatgatttgtatgagggtgttgcagaacaggtggtgaaggttctggctcccatggggttggtttttgatgctaattcaccgcttctggagtcaccggctttgtaactcgccattggtgcacgtctgtgtcgtcgatgcggatgtgtttgatgattccgccgtgttgttcttggagtgtgtgaagctttgcgatgttgtcttctgtggaggcttgcgcaatgagctttcctccaggccgcagcatcatccatgcggtttcaggaactagatcgatgcctaggcctttgttcatgaagatggcatgtgggcttgctgattctggtccttgtacatagcggatatctttgagcgttttgggtgacagggtctctttcacactgagggtggatacacctagtttgcgagcattcctttggctttgctcaaccatggaggcaaaactaatggcgtgcgccttgttgccggctgcgcgtagccaatcgcaggcaagtgctgctccaatatccccgaaggtccacagcatttgtccctgggtgggttctagagctgccacggtcagtgcccgaaggtcttcgtttgatacgtcgccttcaaagtggggtttcggcattgcggtgcgagctcccacagcaatcacgttgagaacagacactgcagctggtggatgtgaagctgtgccttgggtgatctcctcatcagtactgcccaaatcgctgagcacagtcagtggagtctcccccagtccgagttcattcaacaacgtggcaacttgagctgtactgaattcatctttacccaagacgaggaattgagcgcctgattcaataatcgggatgagtgtctcaatgggttcttgtcctaggtacaccacccgtgtgcggttgactgtccaacccaagcgggcgcaagcaagcgacgcggatgatggtcccggaataaccgtgagtctatccatccccagcacatggaccattgcggtgcccacgccgtaaaacagtggatcgccagaggccagaacagcaacatgccgaccgaggaactctttaaacaaggcatctaaatcaggatgcttggtattacccggccatgggcgacgctctgccttaatggcatcaggtacgagattgagctggcgccatgatccaatcaccacagaggcacgttgtaatgcttgctgtgccttgagtccgagcccctcaaacccatcggtaccaataccaatcaaagtaattgattctgctggcgctctaggagctgttgcctgtgctggatcctgggagtcaccgactaccgcaaaatgggtgcgttcatgaccgcgctctgttcctggagcggagtcgggtgctgacatcggttggctcataaccactaattgtagacaaatccccacgatatacatggtgaatcctgcatagaataagtgactgtgaaaccccgacaaccactgactcttatagatctctgcgatgtcatctattcagcagggcacgtattcgatgatttacagtgcacgcgggaagacaccgctgagtttcttaaagtcggttcggtaaacgccattagacataacgtcattgggcatagcggcgatgtggccttgctgcaggaccttcgtgatgtagcagcgtttattatcaaccagccgtgcgcggagttagacgcagcatacctctgtgctcttaactccacgatcacccgtagtgggccgctatatccagggcgtttacgctcaccacaccaacacattggagtgagcaccaactacgggcgccatgaaccccggcgttgaacaccaggcaactagatgcagtgtgtagacggcgcgctcttcccggtaatacggtggaaaaccgtgccatctcactatttatcgacttagcccgagcacagccgtttgaagacggtaacaagcgaaccgcgctctttgtcgccaactccatgctgattgcttccgcctcgccgtatctacttattgcgccagtagatgagaaggattcatcgatagccagaagcttcaatgaccatcttgcataggcttatctttctggagaagacgcgcctgtagcaaccgatctcagagagcatgggcttgtgagggctgaacgggtatctagcgtggcatcttccgccacaccggacgaggaaccatccgcataatccaggcgagaacccgcagacgtcccggaatccacaaggtcgtgctcctcttcttagaggtataagcactaacaacagctgcggcaacatctcgtggatacaccgacatcggagcaggcttcatccccgtggtcatagaaccaataacaaagccaggacgcgcaataatcaatcgcacgtgtgtcccatgcaggctatctgcaagcccttggcaaaatgcatcgagaccagccttggtggatccatagacatagttagcccggcgcgcccgccacccagcaatcgaggaaaacgccacgatcgctgctggagtagtttgtgcgcggagctcatcagcaagcacagtgagcatggagacctgagcggtgtaatccacggtggcgatctctaccgcatgggtctcatcggtttctgcgcgttcttggtctcccaagatgccaaaagcaaccacggcaagggaaatctcgccagctagctcttgtgttttcttcacaagttctcggtgcgtgtctagtacttgggcgtcaaagctcaaaacatgaacagatgtggcaccgcgctgtcgaagatcttccgctaagccctgtgcagcctctggtcgacgagcagccaaaacaacgtcttcgccgtgacacgtcaacgtggcaatctcaccggcaatgtcagaggttccgcctaggagaagaatgctcaacgcagttccttgggctggttgttgagggtttcacaaccgtcttcattcaccacaacgatgtcttcgatgcgcgctccgtggattccttcaatgtagatgccaggctcaatggaaaaggccattccggcttccaacacgagtgagttacccgccatgatgaatggctcctcatgggtggatagaccaatgccgtgtcctgtgcggtgaatgaagtattcgccgtatccagccgcagcaatgtgatcgcgagcaacagcgtccactgattctgcagtaacgccagggcgaacatgcgcaacggctgcgagctgtgcttcgtagagcacttggtagaacttagcgaactctggatccgcatcgtcagggtttccgcccacaatgtaggtgcgtgtgcagtcagagtggtaaccagggccgaaggtgcctcctatatcaaccaccacgatgtcgccattgcggaggactcggtcagagaaaccgtggtgagggttcgcgccgttttcagcggatcccacaatcacgaagtccacctcagagtgctcttccaagatgagatcgttgagctgtgctgcaacctctgcttcggtgcgtccgtcttgaagaagctccgggactttggcgtggacacggtcaatggctgcacctgcgccgcgaagctgctcgatctctgcttcgtctttagagacaaacaattctttcagcacttgaactgccaactccatgcggcaggtggagcccaccaggttctggataggaatcaggtgatctgccgtgatggaggaaccaatacccaatgcttcgaactctgaaacaccgagagcatctacggccaactcatgggcattatcgccatcaacccatccggccacattgatgtctagtcctggaatagcagacagtgctaagtctccgcggtctacagcgggaagaacaatggttgcggttccttcgctggggatcaccaaagcggttagacgctcatgggtggagatccagctgccggttagatacgcaagttctgcgcctgtaccgatgatcaaaccgttcaagccagccttgcgtgcgccttcttgtgcatccgcaagacgctgtgcatataccgatgtggggaaattgtttgttgaaggatcactcatagtctccaaccctagtagcctaggcaggtgtgcgatcaaaccacactgtcagaatcaaatctgctggacgctatgccagcggattgttgatcacgaaaaagcatgtcacagacacctttgtgccttctgtagcatccatctcagagcgcgccacgtttattctcaccgccgatcactttttgcgcagctgctcgaaagtaatttatgtccggggcgaaaatttcaccgccacagcaaccaccagcctgtctgtatttggcacagatctgggtttgatcaaattagacggcaaagcccccaccatgccacttccacttttcgcagataagccacttcgcgtgggcatgaaaaccaccacgttcggattcggcggtctgccatcagccaccgttgctaaagaaatccacgggcgcgttatctctgccatcccccatggcgtatcaagaaaccgcatcacccgagtccatcacggtgccttgatctttaactccccagaaaaggcagtaaagggagactccggcggacctgtgctggttaatggacgagtagccggaatccaatcaatgatctctgaccccggtggatttaacaccggggtcgccactgccgcatcccttatccagcacatgcctgccctagctcaagcgcttgaactgctcgaacatagctagctcgctaggaaccgatcgccacaactccacgcctaatcgcatcaatagcctgacgagcattccgtgtggtctcatcaaagtaggcagtcttagcaacctgctctagaagatcgatgacttgacggcaccagcgcacgaagtcaccaggggtcaactccgcgccgttttccgctgccgcagccatgcaatatcccagcggagcacctgaagcccactggtggatcgcggtggcaaaacctgcttccggctggcgagtaattggcagacggtgacggcgctcatcttcaaccagctcaccccaaatacgttccacgctattcatggaatcagccatggcctctgtgacagcttgagcctcaccaccggtttcgcgacgattttcaaacgtgcacatactcaccacaccggcgagctctgcgggatcaaggttgtcccaaatgccacgcttgaggcactgagcaaccaacaggtctgcctcactgtggattttcgccaaacgctcaccttcatcagtgatcactggattatctggattagagtaatccacatagtccatttcactgagcagcgacaaaatgcgctcaaacgtcctaccgagggtttccctggctttatccacattgccggtcaacttagccagatcacgttctttacggatcatacgctccgcggtgcgagccaagtgctcccgatcaggccaatgatgcgcctcatgatcccgaatagcattacgcagtttggtcactgcctcattgggacgaacccgagcaaactcccgcatcttgttgggtcgcttgaagtgctcacgcctaaacagttcctggacgcgccgggcattgcggcgaggctcttcaatagcttggcgaggcagacgcatatgcccaatggtgatcggcggattagtaaaggattccgcatccacacgacctgaccaaccagattcggtggtcacccatgggcggggatctctgctctgattagcaggcgtcatcactactgcgagaactggtcgttttctaccaggcatggcaatgacatcaccgatttgcagcttggacagcacacggactgtttctacgttgcgatcttcgatgctttgcttgcgattgagtttttcttcctcattgagctcacggcgaagctccatgtagtcgataaacacctccactgcgtcttgatcttcacgcaccgcagggttggtggcagcaatctctttgttcagctgggcacgcaattctgccaccttggcttctgcacgttcaatttcacgcacatcgcccacgacggaaccatcggcttggaactgtgcaaaagatttttccaaaaggcgcagcgaaggctcataaccaatggttttcagcaggttaaccgacatgttgtagcccggctggaacgtagagatcagcgggtaggtacgcgtagaggcaagacctgccacccatcgtggatcaagtgctggtgaccactgcaccacagcattacccaacacatcgatgccacgtcgaccagcacgaccggtcagctgcgtgtattggccaggggtgagatcaacgtggccttcgccgtcaaatttgaccatcttttccaacaccacggtgcgcgctggcatgttgattcccaatgccagggtttccgtggcaaacaccgcgcggacaagacctttaacaaagagctcttccacgatgtgcctaaacgctggaagcatacccgcgtggtgggctgcgaaaccgcgcatcagtgcagcacgccactgcttaaagttcagtacttgaaggtcttcctcggggatccccaccacgccggcgtcgacaatgcgtgcaatctcttctgattctgcttgatccgtcaagaccaacttagaacgcaagcattggtacagcgcaccatcacagcccgcgcgggagaagataaacgtaatcgctggcagcatgttgatgcccttgaggatgctgagcacttcaggccgacccagtggcctgtggcggtcttgttcccgtggcttaccagtgcgagaatcctgcttatcgcctttgctgcgtgcacggaagccttcaccagagcggtatgccgcacggccttgttcgctttgcttgctgttgaggcgatcaatcgttgcctctaactccttgttcacgcgtccatcggtgccaggctcaaacagtggcatcactttgcgctgcaccatcatgtactgatcaagcggaacggggcggtgatcagtaacaatcacacgggtatcgccgcgaacagtggtcagccactcaccaaactcctctgagttggacaccgtggcagatagaccgatgatgttgacggaatcatccaagttgaggatcacttcttcccacaccgcgccacgggaggcatcagcaaggaagtggatctcatccatgaccacgtggcttaagcgctcaagcgcaaaagagcccgcgtaaatcatgttgcgcagcacttcggtggtcatgaccacgatgtcagcatcatggttaatggaaacatcaccggtgagcagaccaacggcatcggagccgtgtttagccaccaaatcgtggtacttctggttgctcagcgctttgatgggggtggtgtagaaacactttgtcccccgcgataatgcgagggacactgcgaattcaccaacaattgttttgcccgcgccggtgggcgcacatactaaaacaccgtggtcttcttccacagcgtggcagcctttgatttggaactcgtccagatcaaagcccaggtctgctatgaactctgaaaggtgggtgcccttttcggcagaaaaactcatgcctctaagggtacctggctaggccctagagcacgtcaccgaagtcggcgcgcccgggtttatagcttatcgacgcctccccacttgggttcagcatccgcgaaggctccaccgcctctggggtttcgactgggcttggagcatcttctccaccagcagaagtatccagtggtgatgcagagaggtcatcgccatcaagccattctgggcgcttcttgtcccggcgtttgtcgttgaaacgacagaactgcagggcaagctctaccagaacggtgagtgaaagcgccaacaccaacatggtgaaaggatcctggccgggtgtcatgaaagcagcgaacacgaacaaaatcatgatgatcatgcgtcgcttatctttaatggcatcgtaaggcaagatacccacaatgttgagcatgccgatcaccagtggaacttcgaagctcacgccgaaaatcgccaacaacgcgagcaagaatccgaagtacttatcaccagtcagggccgctgcctgggtgtctccaccaatggtaaggaggaactccaaaccatatgcaacgacgaagtacgcaagaacagcaccgccgacaaacagcacaacagcaatcgtgacgaagattgcggtgtaacggcgctcattcttcatcaaacctggggtgataaagccccacagctggctcagccacacgggtgagccaagaaccatacccaccaacgccgctactttaaggcgaagcatgaatggatcaaacgggccggttgcgagcagtcgacattcctctgagtcgctcatggcccagcgggattcagcaggcagagaacagtacggatccctcagcagctcgcccaaagtggggatctgccaaaatgagaaatcgtaccaaataaagccgataatggtgcccacgaggatgcccgccagagcgataagaagtcggcgtcgaaactctttgatgtgctcaacaatggacatctctcccgtaggagacttcttcttcttttttgagataactcgccgagggcgcttaaccaccttggcgcttgttgattcagccaattccttgaacgtcctacctgcgtttatgtacagactacgacgcaccgcaacaaaaggtagctgttacggtgcgatgactttattttttagatgcaaactgcccaactttaagaggtgcggtttggatcctcgtagttctgacggtagtcaggggtctgagggttctgaggctgctgaacctgctgtccctggtagtgctgctcaaagtttggctgaggagcctcgatctggttgggcgcaatctgctgctgaggctgctgctgttgttctggggtatcgccgtccttgttcatttctttgacttcagacttgaagatgcgcatggaacggccgatggaacgagctgcatcaggcagcttcttcgcgccgaacagcacgatgatcagcaggacaatgattccaatttcccatggtccgagggacatgtggtctactccaaattcacattaaacaagcttgttcatgactggtgaatgtggggtgaccacgatttccagaaatgaaacccttgcacattgattgatgttgcgtcttactcttgggtgttactctacgtgatgatcatacgctgacaaaccactaaaagccttttgctttatgcatttccgaagatcttcgggactagttactttcaaatgctcagcatggccaatcgcgaatcggacgaaccaatccctagaaagcagcggaaagtggactgtgtgccagctgaatccgtcgctatcgcgaatcggttccaccgtttcatccacctccatggccatgtaattgcctaaccacattgcgtcctcacgcagcaataacgtggcaatatcggaagattttgcgaactcaaaaggatcgtccgtggatactgaaacccctcgcgccgggtgcactgctttgctgtcaagaagcacaatgcttcggatgcgatcaagcctaaacgtccgccattggttcacagcttcttcccaggctttgatgtaggtttcgccttcatgggtgaagatatgagcagggctgacttgcctcaggctggtgttgtctgatctgtgcgagtggtattcaaaactgacctgctggtgtaaatccatggcgtcgcggatgatctctagaacttcagcatcgaggtcttctccagtggagtcgaaaacagtcgaggaatactcccccatgatggcgcgtagcttgttcgcagcagatacgaccgcttcctgtttcgcaataccggggagggattccagggattcaagtgtcagcagcaaaacaccggcttcagttggtgtgaggcgcaagggtttatccatgccttgagcattgtggatttttacttccttaaaggaatgatcaagctccaccaagtcacctggaagaagtcctggcagaccacacatccataatctgttgaggtcttccatgatttgggaggagggttggccaagatcgcgcgctgcttccatgacggtacggcctttatacctggtgaaatacggcaacagattaagctggcgggcaaggtcgctgattttgttggatgatttcggcatgtttacaccacctcgttttcgactttgcgcagcaaggctatgacatcgtcaatgacgtccttgggttctataacgagagcttctggcgcatgggctgctgcggtgcgcaccagccaatctcggtcaacgtcttctaaaaaccatgccccatcggaggtttctacccctgcggcgcgcagttccactgcgcggccgggtgtgatgcgcagggtggcgtcgataagcacactctttctgcgtagttgggcgcgcaccatgtcttggaggttggtgcctgcgggcatggggtgggtggcgtcggcgccgaggttgatgttgcggacgcgggtgatgcggaaggtgcgtgcttcttggcggtcgaggtcgaatccgaccaggtagatgcggtcgcgctcagggaccagaccccaaggatccatgtgtcgaagcgagggggcgtctttgggggcgcgccggtattcgaagctgatttgcttgcccaattggcgggctttgatgatcgcatcgagggtttttgcagacaaggaacctaaatcgcccgcattggtcaaggctgtggacgtggacagatcacgctgcgcgccgccggccgccaatttggtccaccccgaacgcgcgaaggcgccgagttcctgattatggcccatctcccctgccatgcccagcacggcggcctcatctggggtgaattcgacctcggggagcttataagaatcctgggccagacggtacgcctgctggccttcagctatgcctgaggtgaccgtgaactgctcaatcggaacgccaactctgcgcaggtaggcaagatcgcgctgcagcttcttacggaacgccgtatcggtaaggcctttataatcgccgacattgtctcgaatccacacctgggtcaaaaacttccgggaataggaattggcgcttaaaaacgcgaaagtcagattaatctgacgctcgagatcttccttccgatccgacatcaaggcctccgaagtgcgagcggactaactgcgatagctctccgcatgaacggtcatatactcaatcaactgatcaacctcggaattcactgcggaaaaaggatcccccaattccaccgattgtggctccggtcggttgaccttgtgacgcatccaatcgacagtcacaggtactcccagagtatccgccgctttaaggattcgcccgcgcaaatgagcacgtgttgtatcaggagcggtatccaccgcagctaaaatcgcctcatcagtagtccaccgtttgatcatgccgcggctttgcagcacgctaaataggcctctacctggcctaatatcgtgataagtcaagtccacttgggcaagttttggatcatccaacccaaggttgccgcgctgaatgaaacgatcaatgagcttctttttgatcacccagtcaatttctgtatccacttcgctgaaatcaccggactcaatcgctttcaacatgcgaccccacagatccagcacgcgggccatctctgtgttggaggtgccagaaaattctggttcggggcgctgctccaaccacttcgaggcatgctcaaagaccacctgctggatctgcaaggcagtcatggtggtgccatctttcagggacaacagtgtggatcctgttgcatcgcgggagatttccctaattgaggcaatatcattggcaagctctaagctgggcaaaccgaaatctgcctcaatcatttccagaaccagcaacgtggagccgaccttcaacgcgatgctgggctctgccatgttggcatcacccacaatcacgtgcagcctgcggtaagaatgggaatccgcatgtggctcatcacgggtgttgataatggggcgtgatctagtggtggcacttgatacgccctcccacacgtggtcagagcgctgggatatgcagtagcccaaggggaaggattcgcctttatccaaaggattggggtgatggatcctgccggcgccgcagatgagctggcgggtaatcagaaacggcatcagccttttacccaacgccttcaacggcatggagcgacccacaaggtagttttcgtggcagccataagaattgcccacggaatcgacattgtttttaaacaggtacacctgcccagcaatgtcttctttcgccagcgactcttcggcatctacagccatgcgatctgcaataacatcgccagctttttcaaaattgatcagctgggtcaaattatcacactcggcggtggcgtactccgggtgggaacccacatcaagatacaaccgggaaccattgggtatgaagatattagagctggaatatttctccacgatgggacgaaacatccttcgagctatctcatctgggcgaagctttttggaatcaccatcaacaaaggtgaggccatactccgtttcaatgcccatgatcctgcgggtcaatgcggattccacggtactcacagtgactattcgccacccttttgtacataggaacgaacgaattcctcggcgttgttttccaacagtccgtcgatttcatccagcaagctgtccacaccttcggtgttgatctgaacctgtccagatgcctgtgcggaatcctcggcgttgtcctcgtcacgtccgccgccacccataatttgggtttgctttgcgttcactacactcactctcctgccgtaaatcggtatttcttagttcttcagcccacgtatttagacctggccatttaagcctggttgtttaggcccagttttttaggcgtgcgccctaaaacctaagctgagaaccatccacactatgtaacaaacttattgttaacgttaatccatcacacgttagcgccgtcacatgggttagttgaaggggtttggctcacccctgaggtgattctagggacatcccctaaccacctattcagggtaccctaaatagcttggatggccgtgagcggggtcaagttttccttttcaagaccctcaattaactcatcgattgtggcggatttctccaccaactcccctgcttcctctcgggtcaaggtatctaaaccgctggtgtgcacgcggtattccttagcgctggaggtagcaacaatcagcgattcccagttggctgcgagcactgattcgccaaatttatccatcacacgcccgcggaagtatgcccgcgagtcctgcggtggagtggccgctgcatctgcaatgtcctgcgcactgcacagtgttttcatccgccccttggataccagtgcgtgatacagactcttctgtggatcaatatcgctgtactgcaggtcaatgaggtacatcttgggatcgttaatggacagcccacgcgcctcaaaagacttgatcagggcaagttttgcagtccaatcaaggagatggctggtggagagcagatcattctccaggagccccagcacttcaccccacagcgcagtgacacgctgttccactggggtttctgcaaacggctgcaccttgtccaaatagcggcgcagaatatcaatagcggtgagctctgaaccatccgccaatcgcagctggtgggtaagggaaagatcatgggagacctttgctacttcactcactgcgttcttcagcttgagttcagagaaatccaccccagcctcaatggcatccagcactagggaggtcatgccgaatttgaggaaattcgcagtctgcgacatgttggcatcgccgatgatcacgtgcaggcgaccccagtgatcagcgtcggtgtgtggttcatcgcgggtgttgataatgccgcggttgagtgtggtttccagtgaaatttcttgctcaatgtagtcagctcgctgactgacctggaatcccggcttatcgccctgagggcccaatcccacacgtccggcaccgatgatgacctggcggcacacaaaaaatgggatcaatgcctgagccagcacatcaaaatccgtctcacgtgagtagaggtaattctcgtgggacccgtagctagcacccttaccgtcgacattgtttttgtagattttcaaagctggacacggatcatggccgtccaacacagacctattctggctggtgaaactcgcaacatcagagacggcctgcatgaggatgtggtcaccagcggcgtcgtaaaccatggcatcccacgcattggtgacctctggggaggagtattccgggtgcgcgtgatcgacataaaacctggcaccattgggcacaaacacgttggccacaccaatggcgtgcggatccaccacaggggcctggtggtatcggcgcagatcaaagccacgagtatcgcgcagtggggactcttgcgcatagtcccaacgcacccggtgctcaccaaatccacgcgcggtggaatacgccaccaccgcgtgcgtggaagtaacgatcgggcttaaaaacggtgcagacggtgtggaaatgccgtattcggtttccgatcccataaaacgcgccatttagataaccacctctgcgtgagtaacctgcttgccctggcgtccagtgatcctggaccattcatccgggttggaggtgtttggcaggtcttcgctctgctggttttcatcatcaatcgcctggatgagctgctcggcggttaggccaacgccggtgccgtcgatatgcgccttaatagctgattttttagcacggtcaacaatgttggcgatcatcgcaccagagacaaagtcgtggtagttcagtgtttccaccgaaccatcgatcagcgtcaaacgcacataagggcgcggggtgtacaggtgatccacggcgcgatcaatgagatcctcggcaggttcggccagcggaatcgaatcattgatgtagcgggtgaaaatgtcatgtgcgccctgcttgttggggcggttgatgcgaatcttgatgtccaggcgacccgggcgcaaaatggccgggtcgatcagctcttcacggttggtagcgcccaccacgatgacattggacagatcctccacaccgtcaagctctgccaaaagctgtggcaccacggtggtttccatatcagaactcacacctgaaccacgggtacggaaaatcgattccatttcatcaaagaaaatgatcacggggcggccatcgccggcaagctcacgggcgcgctcaaaaatcactcggatctgtcgctctgtctcaccgacgtacttgttcagcagctctgggcccttgacgttgatgaagtacgaggtgccagtctcaccgatgcggttggccaaagaattagccacagccttagcaatcagcgtctttccacagccgggagggccgtacagcagcacgccctttggtggatgcaggttgtaggcgcggtacatctccgggtgcaaaaatggcagctcaacggcatcttgaatcaattcaatctgatcatccaagccaccaatatcctgataagacacatctggcgcctcttccagcgcaagcctcgaaatttccgtcttggcaatcgcctcaaaagcgtagcccgctttgcggtcaacaagcagggtgtcaccggggcgcggcagctttgcggtgcgatccatcaacggaccagcaagcttgacgacgcgctcctcccccgagcgatctgaaaccaaagcacgatcccggccaatcatttccatcaacgtggctaattcaccggtttgttcaaaatcacaggcctcaagaacttgattgccttcacccaaacgaacctgcacacccggcatcaaatccgcggcacacagcataggagaaacagccacacgcatgcgacgtccaccagcaaagatctccgcattagaaccgtctttcgcggtttccaagaaagtgccatacaccgatggcggctgagccatatcctccaactgagaaaacagcacagacaatttatcccgagacgacttcagcatctccgcgagcttggcattacgtgccccaagatcagagttggtgcgcttgagctggcgcacctcatcagataaccgggactgttcctcccggttgaagtcgctaaaagaattagagggcgaagaatcagttggtgaactcatggtcaccactctaaccctttacgccctccaactaggtctttttatcgacgtgccttacgctgcggacgaggaggctccacgccatcagccaaacgcctggtcaacaccaagaacgcggtgtgggcattcatgcggtgctcagggcgtgttgccaagccctccaccttccaatcacgaaccaaagattcccacgcgcgtggctccgtgaagcatttttgctcgcggatgccttccatgaccttcatcagctgtggcacggtcgccacatacgtcataaacacaccaccagggatgagaagatccttgcaggtctccagcatttcccacggctcaagcatatccaagatgatgcggtcaacaggtccgccgagatcctcaacggtgacttctttcaggtcaccaagacgtggatcccaggttgctggacgctcaccgaagtactcctccacgttggagactgcgtactccaggtgatcctcacggatttcgtaggagatgacattgcccttttcacccactgcacgaagcagcgccatggacagtgcaccggaaccagcgccagcttccagaactcgggcgccagggaaaatatcgccctcgaccagaatctgtgcagagtcctttggataaataactgcagcgccacgaggcatgctcagcacgtgatcaaccatgaggtgacggaagcacaagtaatcagagcccatggtggagtggacaacagtgccctcatcggcgccgatgatgtcatcgtgtgcgatttgtccacggtgggtgtggtaggtggttcctggttccaaaatgatggtgaaatggcggcgtttagcgtcggtgagctgaacgcggtcgcctgcttggaacggacctgagtagggcatgagccctcactttcttctgtgtgcttgtcttgattgaactcggcgttaatttaccagataggcttccagggcttgttcaaaccacatcagatccttcactccggccatttcgcgtgcggagtgcatggacagcaatggaataccgacatcgacagaatcgatacccaggcgagtcgcactgatcgggccgatggtggaaccacacggcacatcgttgttgccggcaaacacctggtgtggcacaccggcaatctgacatgccctgatccacatgcctgaagtgactgcatcggaggtgtagcgctggttggcgttgaccttcaatacaggacctttaccaatgatggggtaattagcttgatcatgcttctcggggaagttggggtgaatggagtgtgccgcgtcagctgagaccatggtggaacggttaaacatccggcgtcgctcatcttcatctgcacccaacgcacgagcagtacggttgagcacatcctccaacagggggcccccggcacccgaggtggaattacttcccacttcttcatgatcgaatgcagcaagaaccaaaatatccgaaccagtatcgtcagattgcgaagccgcaatcaatgcagtcatggatggatgcacgctgctcaggttatccaggcgaccagacgccaagaaatccccatgtgcgccaaatacttcagcatcttgggtagccaccgtgatcagatcatggctgacaatatctgcaggatccactaccgcagcaccagcaatgacatccagaattgatacgtcgggctcaccaacagcaaacacaggctgcaggtgacgctgtggattaagggtgagttgggaattaacagtacggtccaaatgaatagccacgtgcgggatgcgcagaatcgggccggtgttgacaagcttgacggacccgtcggcaagcacaatgcggcctgctaaggccagctcgcgatccagccagcttggcaggatcggtccgccgtaaacctcgacgccggcctgctgccaaccgtgtgaggaaagatccccacggggctttaacttgaaacccggtgaatcagtatgtgacccaatgatgcggaacccggaatctggcgaagcatcctcaggcacccaccacgccactactgctcccccacgcaccgtcacatgcccaccagggcgggcatcccattcatcggtatcttcctgacgaatgaacccctcatggagcaacctgcgctccaccgccgcggccgcgtgataggaacttgggcttagggcaataaaacttaagaaatcgtcagttacatgcatagaacaagggtagccaaattcttggaaacagcgcgggcccccgaatccacaatgcgaatccacaatgtcacctgaagccgttaaagtaggtgatcattatgaccagcccagttgaaaacgttaagaaaaagccacgcccattggcgctgtcaccgtcgcgcgccggggattaccagcagtgtcccctgttgtatcgcttccgcgcgattgatcgcctgccagagcctaagaccgtcgcccaggtcaaaggcacgttggtgcacgctgtgttggaatatatgcacaagttgccgcgtgaagaacgcgaatatccagccatggtgaagcaactcaagcccacctgggcgcagatgtgtgaagaagacgcagagctcaaagagcttgttccagaagatgagctttatgatttcctcgtggattcccgcaccctgctgcgtggctactttgaaatggaaaatcctcaaggtttcgacgccaccgaatgcgaaatgtacgtggacactgtgctgcccaacggcgttcctgttcgtggttttatcgaccgtgtggataccgcccccaccggccaagtccgagttatcgactacaagactggcaagaaaccaaagccgcagtggagccagcaagcgcagttccagatgctgttctatgcactggtctactggcgcatgttcaatgaaatcccagctcagcttcgtttaatgtacctcaaagtcaacgattcaatgttcctcaacccatcacgggagcagctggaattcttcgaacgcgatctgggtgatctgtgggcaaagattgaaatggacggcaaagcaggccattttcgaacgaagacctccaagctgtgtggctggtgcccacaccaatcactgtgtccggagtatggtggggttccacccgagtaccccggttggcctggcagtacagcagactagcctagtcgtgagtcagtctaaagtttgatattttgatggttaacaaaacgactagggaaaatgcaggttagggacgctttacctgcgttgcgcgggattcaaacatggatatcatttttaacaagaacctttttcaaacattctttttataagttttttccatattggttgatcccccaccatcgggatccctgatccacgaaaggagtgttcgtggtagctccgcagtcccggaaaccgcagcaccctggtgagattttgagtgaacgtttcctcgaaccccgaggaatcagccactacgatctcgccaaaaccctccacatcaccgaagcaaccatcgccaatttcgttgaaggtcgcaccgacctcaccatcggacttgcagtacgcctctcccgctcattcgatttgagcacacaggaatggatcgcactgcagcgcacctttgatcaggctcatcgtcgatctgcttaaaagtttttagcttcatcgaaacacccgcacttgccggctataacgccaggaagtgcgggtgttttgctcttgatgaatttcataaaacgacaaagcacctccatcctccgagttcgccttggggatgcaggtgctcaataaaatgctctaacttagtggctagctttcctacccaaagcaaccaggtagagcacgcccgccacaacaatcactgcggccaaagctgcgtacatgacgttgtatccggtcgctgcaaccaatccacccagcaggattgggcctaagccaatgccgatgtcggtgaacaggaaaagcgtagaaataccggaaccaacctgagtgcttggaactgaatcgacagcaatggcttgtgcggccggcatgatggtgccatagcccaaaccggtgagtgcgccagcgagaacaatgtgccagtcttcagtcgccaaagccataagccccagcgcgagggcgaagctgatcaaaccgaagtaaataaccgggttgtcaccatgtttgtcctgaatgcgtccaaggaagaaacgcatgaccagcatcgcaaccgcataagcgataaagaaaagacccgctccggcggtgaggccagtgtcttgcgcgaagccgttgaggaaggtgatcacgcctgcgtaagccagtccgacagcgagcatgaagaatccaatgagcatgaccgatgggtgcacaacagtcttgatagaccagactggctttactctgccgtgttccgcattcttaatgaactccggcttgcggatcaaaacggtgaggatcaggccgaaaacactggtcgcagtggtaatccagaacagggtgttgtagttgaagtcatcgataacaaacagcgcaattgctgggccgaaagctgtagccagtgtggatccgagcgcgaagtagccggtgccctctgccctacggcttgcaggaatcacggactgcacaagtgccatcacagcggtggaagcaagagaataagaaaaaccgtgaacaaaacgcacagcaaccagcgctggtagtgaggcagctggaatatagaatagtgatgctaccgttcccaagccgacaaagatgagcaggatctgcttcttaccaaaacggtcggccgcccatcccgcgaacacacgagccacggttgcgccgataacaaaggagctggccgcaaatccgccagcggcctctgaaacggcgaagctttccatcgcatacagcgccatgactgtgatcaggaagtagaagctcaagtactgggtcaagttgacgagccagcccaaaataaacactggagtgaacagtgccgttggttgcgatgggtgtggttttatgtccgttcttgcggtgaccgccacgcagtcctcctatgttgttgattggccaaattgcaaaaattcaatagatactttaagtattatcctattgcattgtacaaaagtgcaggttaaaaggccattcaatgtctttagaaacctaatcgcatccaaaatagattcatgtcacaaaacgctttttgcttttcgacggctgcgcccgaccaaaacaacctcaacgtgttgccccacccccttcgcaccgtcccatatgaccgaaaatcgattgactgggaagcttcggccatatagtctgctccgcgtgtagtcgcgtaaaaaatctcgccgactcatccagcgatatcaatctcttaaacaggcgcctgctgaattcacccacgaaaaaacctgggcaaccaggtgagatgaactctcaacctaattgcccaggtatcagacgagatcttggattagttctccaagtagagccttccgcggaacattgggtgcatgaggttctccttggacaggactgcctcgagcgtcttttcatccatgagcttcttttccaggatgagttcacgcactggtcgaccagtttcggctgcttccttaccgatctgatctccaatgtcgtggcccaggaatgggttcaggtaagtgataatcccgatggagttatcaacgtaagcacggcaaacatcagcgttggcggtgattcctacgacgcacttctcacgcaaagtcttggctgcattgcccaggatgcgcagtgactggaagagggattcgccaatgactggctccatgacgttgagctgcaactggccagcttccgcagccatggtgacggtgagatcgttaccgaagaccttgaagcagacctggttgaccacttctgggatcactgggttgaccttggctggcatgatggaggaaccagcctggcgtggtggcaggttgatttcgttcaagccagcacgaggaccagaagacagcagacgtagatcgttacagatcttggacagtttcatggctgcacgcttgattgcggagtgcgcatgaacatatgcaccggtgtcagaggtagcctcgatgagatcacgtgcggactttagttccagtccggtgacctcagacagagcagcgacaacctggtggcggtagcctgctggagtgttcacaccagtaccgattgcggttgcaccaagattgacctcgaggagacggttggcagcttcacgcagcacggtctgctcttctgcgaggttgtgcgcgaatgctcggaactcttcgcccaagctcatgggaacagcatcctgcaactgggtgcggcccatcttgatgatgtcgacaaactcattgcccttgtggcggaacgcaacctgaagctcatcaatttcagcgatgagggtctgcagtccagcgtaaatgcccaggcggaaaccagttgggtaggaatcgttggtggactgggacatgttcacatcatccatggggtgcaggatgtggtactcgcccttttcatggcctaagaactcaagtgcaaggttggcaacaacctcgttggtgttcatgttcagtgaggtacctgcgccaccctggaacacatcgatggggaactgatccatacagcgttcctcaatgaggatctgatcacaagcccagacaattgcttctgctttttgtgctggaagtgtgtgcagtcggcggtttgctaaagctgcggcctttttcacctggaccatgccgcgaatgaaatctgggacgtggttgatggtggttcgtgagatttggaagttgtccaccgcacgaagggtgtgcaccccgtaatatgcgtgggatgggatctgaagttcaccaagcagatccgattcgattcggaactttttctgaaccgtggtttttggttcgacgacacgttccgaaactgcagcgctgtctgaagactgcgactcattcgtggcgatttggttctcgccgttcacaatgtcttcggcttttgcgtcattctttgagtctgctgaagacttgttgctcgtcttagacatgtactgcctctcacaagttgaaggaaatcacaatggtgctgtggattatcctacgtacttgtaagaggcagtgtggaactacccactacattttcgggggtagttaaaactagatgcgggcgatgcggatttcagaagccaggatggcttcagcgccgagtccagcaagcttatccatgatggcgttagctgacctgcgtggcaccatggcgcgtacagcaacccagttgtcgcgtgccagtggggataccgttgggccggataagcctggggttactgcagtggcagcgtccaggttgtcgcggtcgacgttgtaatccagcatgaggaagttctgcgcgtgcaaaattccctggatgcggcgaagcaggatctgctgctctggggtgaccttttcatccttgcggccaacaatgacagcctcagaggtgcacagaacctcgccgaaaggtgcaagaccttgctgacgcagcgtgcggccggtggatacaacatcggcgatggcatctgcgacaccaagcttgatggatacctctactgcaccgtcgaggcggagcacctcagcggaaagcccacgtgctgcgaggtcatcgcgaacaaggttggggtaagaggtagcgatgcgcttgccgtcgagcttttcgatgctccactcttcatcagctggtgctgcgtaacggaaagtggaggaaccgaagccgagggaaagaacttcgtggacatcagcctgggaatcgcgagcaaggtcgcggccggtgatacccaaatcgagctggccaccagcaacgtagatggcgatatctttagggcgaaggaagaagaattcaacgttgtttgcttcatcaaaaacgttgagggatttggaatctccacggcctgcgtagcctgcttcggcgaggatttccatggcgcgctcggacagcgagcctttgtttgggacagcgattttcaacatgattgctttaaaactcctacaggttcttgtagatatcttctggcttcaggccgcgagcaaccatgatgacctgggtccaataaatgagctgggagatttctccggctagctcttcatcggtctcatactcggctgcaatccagacctctccggcttcttcgatgaccttcttacctagatgatggatgcctttatccaaggcggccacggttccagacccttcagggcgggtctgagcacggttaagaagttcttcgtacagcgagtcaaatgtcttcactcggtacattcttccacacaacagttatcaatgtgtgtttgggggaggatattagtcgaataatttcactcccccacctggttttattttgcgacacctgccggctcgatctggtggtaccaggcagtgaccatctcagcggtgacaccttcgaaagagtttttaccgtggagggaacgcaaaggcactacaccttctggcgcttggacttcttctgggtgcagaccaatgacgcggcaacctgcagtaacagcgcccagcatgccgttgtaggaatcttcgaacacgaggcactctgatgggtcaaagcccacacgtcgtgctgcttcgaggtacatgtcgggggctggctttgctgttgggacttcatcaccagcgatagaaccgatgaagaactcatttcccacggctgcgactgaacgggtcgcgagatcgcgctctgtgttggtggtgaccaacatggggatctcgagggccttcaactctgtcaggagttcggtgacgcctggatttgggacgagggattcgtcgaaaagctcatggacccgggcgaacatgccagcccggtagcgctcgtagtccgcgtcgctcaatgtaatgcctgcgtgctctgcgcataagcgcatggtgcgcggcaggctcgagccgacggtgagttcccggagctccggggtgaggcggcggcccatggcttcgctgagctcgtaggtagcaatgccccactgtggctcagagtccaccatcgtgccgtccatgtcccagaaaatcgccttaatcatgccgtcaaccttagttaaagtggcacgatctgcaatgtgcgggaaagttttccctctcaaaggtgttagacgttaaagtactttgcctctgggtggtagagcacaaacgcgtctgtggactgctctgggtgcagctggagttcctcggacaactccacgccgatacggcctggctcgagcaattccaccagctttgcgcggtcttccagatcagggcaagaaccgtaaccaaaggagaagcgggcgccgcggtaatccaggtcgaagaacttggtcttgtcttctggatcaaaatcagcgacagatccaccgtcgttcagcttgagttcgctgcgcactcgggagtgccagtactcggccaatgcttcggtgagctgcacgccgatgccgtgaacttccaagtactcgcggtattcattggctgcgaacaactcgttggcgaaatcagcaataggattacccatggtgaccagctggaatggcatgacgtccacttggccgtccttgacagcttgctcgcgtgggcgaatgaaatccgcgatgcacaagaacctgccgcgctgctggcgtgggaagctaaagcgcatgcgttcggctgcgtgtggatccggggattccaagatcaccacgtcatcgccttccgcgaccgctgggaagtagccatacaccaaggccacgtggtccaaaatgccctcagacttcaggcgatccagccagtagcgcaggcgtggtcggccttcagtttccaccaaatcctcatagcttggaccctcgttgccgcgggtggatttcagaccccactgccccatgaacaaggcgcgctcatcaaggttgcccaagaactccgccaagggcagacccttgacaatgcgggttccccagaacggtggtgccgcggttggagtatcggtggagacatcagaacgctccggaacaatcacgggagccgcattagctttacgctccgcggcaatcttgcgggaacgctcattacgagccttacgttccgccttcttcttcgcctgctcaatagcttctggtgagttgggatcaagtccttcaccacgcttttctgccatcacctcatccatcaggcgcaggccctcgaaagcatcacgggcgtagtacacctcaccggtgtacacctcgttgagatcgttttccacgtaggtacgcgtcagcgcagcgccacccaaaatgactgggtaattggatgcgccggcgttgttcatctcctcaaggttttccttcatcaccacggtggacttcacaagaagtcccgacatgccgatgacgtctgctttgtgttcttccgctgcttccaacatggcggacagtggctgcttgatgcccaagttcaccacgtcgtaaccgttgttggacaaaatgatgtccaccaagttcttgccgatatcgtgcacgtcacccttgacggtggccacgacgattttgcccttgccctctgcctgcgcagatccggtagcttctgcttcctcttccatgaacggttccaaataggccaccgcagttttcatggtttctgccgattgcagcacgaatggcagctgcatctgtccggaaccaaacagctcacccacggtcttcatgccgttgagaaggtcctcgttgatgatcgcaataggagacttctccttcatgcctgcttccagatcatcctcaaggccattcttatcgccgtcgatgatgcgctgtgccaaacgctcaaacaaaggcatagcggccagctgttcagcgcgagcatccttggcatcggcagcagaaacgccctcaaacagctgcatgaattcctgcagcggatcgtaatcctcggtgcggcgatcatagaccatatccaacgccacttcgcgctggcgatcatcaatgcggttcatcggcaaaatcttggagctgtgcgcaatcgcagagtccagaccagcctcaatgcactcattgaggaacacagagttaagaacctggcgtgcagcagggttcaggccgaaggaaatattggacagacccagggtggtgtggatttctgggtagagcttcttcagctcgcggatggcttcgatggtttcaatgccatctcgcctggtttcttcctggccagtagagatcgggaaggtcaggcagtccacaacgatgtctttgatatccaggccgtagctgccggtgatatcgtcaatcagtcgtttagcaatgcgcaccttgtgctcagcggtacgtgcctggccttcctcatcaatggtcagcgcaaccacggccgcaccgtgctgctttaccagtttcatgatgcgctggtagcgggactcagggccatcgccgtcttcaaagttgacggagttaacgatgcttcgtccacccaagtgctcaaggcctgtgcgaataacctctggctcggtggagtcaatcatgattggcaaagtggagctggtagcaagaagtgctgccaaggtcgccatatcggcggtgccgtctcgtcccacgtaatccacacaaagatccagcatgtgtgcaccatcgcgggtttgctgcttggcaatatccacacacttttcccaatcgccagacagcattgcctcacggaatgccttggaaccgttggagttggtgcgctcaccgatcatggaaatgccggtttcctgggacaatggcaccgaggtgtacagcgacgcgacggagtcctctttctccacctcgcgggaggcctgctcaacagggcctgcagggatcttggtcagtgtggaggtttcctgctctggaacaccaaccaccgcatcgcggaccgcacggatgtgctcaggtgtggtgccacaacaaccacccaccatggacaggccatattcggagacgaatccagccagcgcctgcgccaaatcctcagcctcaagtgggtattctgcaccgtttttacccaggacaggaagacctgcgttaggcatcaccgacacaggaatatcggcgtgcttggacaggtaacgcaggtgctcgctcatctcatctgggccggtggcgcagttcagaccaatcatgtcgatacccagtggctgcagcgctgtcaacgcggcaccgatctcagaacccatgagcatggtgccggtggtctctacggtgacgtggcaaataatgggcaagaatgtatcaagttcagccatggcatcttgaacgccgtgaaccgcagccttgacctgaagcaagtcctgagcagtctcaatcaaaaaggcatcgccaccaccgtcgatgatgccaagcgctgcttccttgtagtgcccacgcaaatctgcatacggtgcatggcccagcgatggaagcttcgttccaggtcccagggaaccaaccacgaaacgccgcatgccgtttcggcccggccccatctcatcagccacttccctagccactgcagtgcccttgtaggcaagctcacggcaacgatcagcgatgtcataatccgccaagttcggcaggttgcaaccaaaagtattggtctcaaccaagtcagctcccgcctcaaagtaggcgcggtgaatctgcctcaacacatcagggcgggtgtcgttgagaatctcattacacccctccagatcaaggaaatccttttccacgtccaggtcaaagccttggagctgggtgcccatggcgccgtcgccgatcaacacatggtttgccaacgcatccaaaaattcggaggaatgtgcgttgttgtgggctggtgaagtaactgaagtagacattgtgtagacagcttagtacggattagacaattcccgaacttttcattcgtagttcattttcaacgccgcctaagcaacacaggcaaagcgccactagtctcggtcgcatgactgactccactccgcaaggctcaacaccaggcatgtcccctgaagctatcctcaacggcaccggaaagccgtgggaagagtggctaaaattgcttgacgacgtaaaagccacctcttggactcacacccacatcgcaaagcacatcgtggacaactttgatgtcagtggctggtgggctcaaggcatcgcgattggttatgaatacgaacgtggcatgcgcaaacccgggatgaccagcgatgggttcgcggccaatgcctccaaaacccttaacctgccggtcgaaaaagtgtggaagctcttcggagacgatgacctgcgggcgcagtggctcgatcccgcactaattgagaaaacctccgcctccgaacctagaacattcaatgccaaatggttggccgatgattctcgagtgagcgtcaacttcacctccaaaggcgacaataaatccagcttcggcatccagcacagacgcctgcctgatcaagacagcatccctgtcatgaaagcattctggaaagaacgcatcgctgcattagttgaggtgtcaaaacaattttcgctttaacattaagttcttagccttcaaactatttaacgactttgccgactgacgcggcaatctctttggctgctcgcttggcataaagcccgacccctgtgatagtcgcagacccaggtcccgtccaatctccgtagcctactaaataaagaccaggaacctttggttgtccgtgtttgagaagttgacgaactggcctaatcgccggccgaaaccctgtgcaccaaattaggtgatcagcacgtatctcgtcgagtgacccaaacatcggagtggcaaatagctttccggagtctcgagccctgcgcacctccggaagcatgacaatgtcgccgagctcggaatctggccctgggtcacgttcacctcgttgaatagcaagagctctcaaacggttacgcctaaacaattccctaccatcaacgtcatctggcatccaccgtggtttatcgcgggtgaaccatgtcacctcactcacttcactcagctctgctgcaatttgagctccggaatttgcacctccaacgattgcaatgcgttgacctacgaaggggtgaacgcccggataatttgaagagtgccaatgagttccagagaattttcccggaaaagttgggacaaatggcgccgaccaagtaccggtagcggcaaccacgtttttagctatccaggatcgagttccagattgtaaatgaaaggcaccatttacaaaatcaaccttatctacagaaactgatcgactaactggaatttcataacgccgttcatattctgtcaggtaatctacgacatgagacgatgttggaaacccgtcaaatttgggcatcggccaacctggaagattagaaaaatctgaagtcgaaaacaaatgcagcgaaggccacacatgcagccatgcacctccggaggcaggttggtcatccaaaatcagagtctgcactcctgcgcgcatgagataataagcggtagccaggccagcttggcctccaccaattattacagcttcgtaatggtcatgatcgtttccggcgccttcagtttgcaaacgactcatcataattccattgagccgatctgcaataccgttcgcaattccgcaaataattccggccgtactcgatgcaacaccacacgaccttcaggcactcgatccaaaaatcctgcttcagtcatctttttaagatgatgtgagattgttggttggctaagacccattaagtccgtgagttcattaacacttacaggcccgcaccctcccgcagccagctgagacagaatccgtagacggactgggtcgcccaacaccttaaacagatcggcatagtgttcagattcatcactggacaggggtcccgtagcaagggtgcaacactcggttggattggctaattgaattgtgtggagagtggtcataaatccactatatattgacgaatgtcgatattgaaagtattttgaatatcgacaggtatcaatataccgaaaggtgtcgcatgacaaactcaactcagacgcgggccaagccagcccgaatctcatttcttgataaatacattccactttggattattttggcgatggcgtttgggctatttttaggccggagcgtttcgggactctcaggctttctaggcgcaatggaagtcggagggatctccttgccaatcgctttaggcctccttgtaatgatgtacccaccgttggccaaagttcggtatgacaaaactaaacaaattgccactgataagcatttgatgggcgtgtcactcattctcaattgggtggtgggtcctgccttaatgttcgcgctagcttggttgttcctcccagaccaaccggaattacgaaccggcctgattattgtaggactcgcacgatgtattgcgatggtcttggtttggtctgatatgtcctgtggagaccgcgaggctacagcagttctcgtagccattaattcagtttttcaagtcgcaatgtttggtgcacttggctggttctatctgcaagttttaccatcctggctaggattaccaactaccaccgctcaattctctttctggtcaattgtgacttcggttttggtgttcctcggaatacctctacttgctggagttttctcgcgaattattggcgaaaagatcaagggacgtgagtggtatgaacaaaagttccttccggcaatctctccatttgcactaatcggtctgctttatacgatcgtcttgttgttttcattgcaaggtgatcagatcgtctctcaaccatgggctgtagttcgtctcgcgataccattggttatctatttcgttggaatgtttttcatttcactcattgcgtcaaaactatctggcatgaactatgcaaagtctgcatccgtctctttcactgcagctggcaacaattttgaacttgcgattgcggtgtcgatcggaacgtttggcgcaacttctgcacaggctatggcaggaacgattggtcccttgattgaaattccagtacttgtcggcttggtctacgccatgctgtggctaggccccaagttgttcccaaatgaccccacgctgccatcatcagctcgttctaccagccaaatcatcaactcatagcgaaggaatcaacttcatgaataatcaaccatcagtacttttcgtttgcgtcggcaatggtggaaaatctcaaatggccgcagcgctagccaaaaaacatgccggggacgctctcaaagtttattcagctggcacaaagccaggtacgaaattaaatcaacagtcccttgattccattgctgaagttggcgcagatatgtctcaagggtttccaaagggcattgaccaggagttaattaagcgagtagaccgcgtggtcattcttggtgccgaagctcaactagaaatgcctatcgatgcaaacggcatactacagcgctgggtaactgacgaaccctctgaacgtggaattgaaggtatggaacgcatgcgcctggtccgagatgatattgacgcccgagtccaaaacctcgtcgctgaactaacccaaaacgcatagcagttttctaatctcacacatcttcaacaccgttaaatctattggtttccccgtaaaatcttcgaaaggaagaacatgaccgggcaagctgcaccaaacttgcataccaatattttgaaccgtatcgcaaatgaactggcgttgacctatcaaggagttttctctgcagagactatcaaccgctatatttttgaatcgtatgtgtcgttggcgagaacagcaaaaatccatacgcacctgccaattttggcagaaggttttgctaaagaccggctgcacgcacttgcggtagctgaaggtaaggtggcttcacctgtgcctcaggtcctatttatttgcgtccacaacgcaggtcgttcacaaattgcttcggcgttgttgtctcactatgccggtagttctgtagaggtacgttctgcaggttctttacctgcttctgaaattcacccactggtgttggaaattttgtcagagcgaggagtgaacatttctgatgcatttccgaaaccgctaaccgatgatgttattcgcgcatctgactatgtcataacaatgggatgtggagatgtgtgcccaatgtatccaggaaagcactatcttgattgggagctcgctgatccgtcagatgaaggtgaggacaagatacaggaaataattgaggaaattgacggtcgaatccgcgagctttggaaaagcattcaattatcgcaaaactaggcagtcaaaggtctggcacccccattgccctgttgaaactgatatcgagcctcacatagggaaactacgcgaggctcgattgctcgttggttaagcaaaaagtgaatcctccaacaaaagcgccatcccagcctcaaccggaatggcgctaaaaaacttctactgaaatttactcaaactcagggaaagcctctgcagaaagatcatctgcaccagtctgctttgcagcatcaaacatcaatttagtgatctcttctttttcttcaggctcaacaacagcaccgtggtgctttgtgttgaacttctccagctcatcaagggtggactgagcggaggcgttaacagcatcaaggtctggtgcttcaccgagcttatctagggaatcaaggtagttttccaagatgaaacgaagatctggaagtgccttgacatcgaaaggttcgtcccagaattccttttcgtcctctttaaggtatgaacctgttgcaaactcttcgagagtggagatgaattcatctacggaaggctggaaagtggcgcgaatggtcatgagatgtattgttcctgaaatttcctagagctgcacgcccaggagggcatcaatggctgcgaccacgatgtttcctacctcggtgaactcttttgaatcggtcgtggtgtcgatacccgctgcccaattatctaccgcggcgagcgcgccgggagtatcaaggtcagcagataggtgtgcacgaagctgctcgacaactgcaatggcatcttccctattggttgcagctcgtgctgcttcacgccaggttgctagacgctgttctgcggtggcgaggctctctgcgttccaatcacggttgccacggtaatggttggcaaaaacaccgaggcggatcgcgccgggctcgtggcctgcagcggtgaggcgggaaacaaattccaggttgcccaaagacttggacattttcacgccatcttgggatatcatgccagcgtggacgtagtgcttagccatgcgctcgacaccgtgagctgcttcggcgtgcgctgcggagaactcgtggtgagggaagatcaggtcagagccgccaccttggatatcaaagctgtgtcctaggcggttggtagcgattgctgaacactcgatgtgccagccaggacgacctgcgccgaatggggattcccagcttggttcaccttcgcgggctgcgcgccacaggagggcatccatggggtttttcttgccgggacgctctgggtcgccgccgcgttctgcgaagaactcagccatggtcgctgcgtcgtaattggactcgtagccaaatttgtctgtggcgttgattgatgcgtagacatctggatattcggcgtcctcgacgatgtacgcggcgccttcgtcgagaagcgtcttgaccatctcaatgacttcgtcgatggactcaatcgcaccgatgtagtccttcggcggaatgatgctcagggcttccatatcgctgcggaagaggttgatttggctggtgccgaggtcgcgccagtcgacgccgtcgcgggctgcgcgttcaaacagagggtcatcgacatcggtgatgttttggacgtagtggacatcgtgatcattgtccagcaggatgcggtagatcagatcgaaagcgaggtatgtcgccgcgtgccccaagtgtgtggagtcgtagggagtgatgccacagacgtacatgccaaccggtgtgtcggatccggcaggtggggtttcaaccaggcgtacttcctgatctgcagtgtcgaacaattccaaaggcacaggcgtgccagcgagagcaggtacttcaggtgtaggccaagattgcatgggttttactctatcttctttccgtaattatttccgcgacaagctatttgcaagctatgtgcaggctcattgcacaagttcagcgcggagacacgtcctaaaaaatacttatgaaattatgttcgacaccgaaatgtcacctgaaacttcaaccaagccgccagtgcacctattccacaaaccaaaaaatccgccaacacgaatgcggcggatttttaagatgtacaggaattttatgggttgagcatgcccagtgcgagcagcagcatcacgagcagacctgcaggaatacggtatgcagcaaaccagctgaaggagtggtttgccacgaacttcatcagccacgcaatggaaatgtagccaactacgaaggcaaccagggtacccacggtgagctgtaggccggaggcagcttgtccggagcttggcgcaaaagcgtcaggcagggagtacaaaccggagccaagcactgcagggattgccagcaggaaggagaacttggtggctacttcacgcttgagaccaaggaacaaaccagcagagatggtgccgccggagcgagacacgccagggatcagcgcaagacactgtgcaagacccatgatgatggcatctttcatggtcagtttgtcgtagtcgcgttccttcttgcccatcttctcggccaaaatgaacaccagggagaacaggatcagcacggatgcagtgatccacatatttcgcagcgcctcacggatcaggtccttgcccaacacacccaagatcacgacgggaatggtggcaacaatgatcatccagcccatgcggtattcaaatccgcggcgttccttattgaatacgccagcgaaccaacctgtgatgatttgccagatttccttggcaaaaaacaccagcactgcggcttcggtaccaagctgaaccacggcggtaaaggacgcgccggcatcggcaccccagaacagctcagagatgattcggaggtgtccgctggagctgatcggcaggaactctgtgaggccttgaacgatggagagcacaatggtttgtacccagccaatattttcagttgcggcaggatctgctgctgcggctaggagggttatctcttcattcacccgatctaccgtactaccttatgacctcagtagtgtggtgggcgtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctgtgacttggtccaattacattcactggtaatctgaaaccttgtgaatatgcgccgtcgatcccgtgtgtcccgtttgcttcccgccacagctttgctggcctcaactgcacttcttttaagtgcatgtacgcaaggggtaacggactccccggatatgggcaaggcaactcccgctgtctcccccgcagcaagcaacccggatggccaagtaattgagttcggcaacatcactgacatggaagtcactgatggtgacatcctcggtgtacgcaccgaagacgcactcgctattggtacagtctccgacttcgaagcgggtagccaggtggaactggacgtcgataagcaatgcggcgacctgaccgcaaccggcggcactttcgtgctcccctgcgccgatggcgtttatttgattgatgccaaggacccggatctggatgagttgcgtgcaactgacaagccagtcacggtggcagccttgaccagcgatgatcagcttctggtgggcaatggtgaagatgaagaactcaccatctaccgcgagggcgaagagccagaaaccttcaccgtcgcgggtcccaatacccagctcatcgccgttcctgtcattgatcgccacgacgccgttgtgcgcacctggaacgaaaacaccacgattcaagatgtggactaccccaacgaccgtgaaggcgcgacccttcgcgtgggactcggcgttggtcaaatggctggtggcgaagacggcctgctggtggtctctgatgaaatgggtggccaaattgccatctacaacgctgatgatgtcatccgacttcaaatgaccgcccccaccgacgagaacccatgggccgttgcctgggattcttccaacgcgctcgcctggatcacctcactgaccgaaaacaccctggtcggatacaaaatctctgaaggcgtgcctgaggaagaacagcgcttaaacaccatcgcagacgcgcaaaacctcgtggtattaagcgattccaccctcgtcgtagcatccgcaaccggcgacggcatccaaatcatcgacaacccagcatcttaaaaaggacacccatgagcaagcaatcccccacccgcaagctgcgtcaaaccgtctacgatgccagcctcaaagtgatgttcaccctgcgccccgaacgcatccacgggataatgaacaaagcactcggagtcgtcgacggcgtcgcacctctaaaccgcaccatggaaaaaatcatcgcagtgcacgatgattccctctcccaggaagtcttcggcgtcaccttcccacgaccactaggcctcgccgcaggtttcgacaaaaacgcatcaatggctgatgcctggggtgccgttggattcggatacgccgaacttggcaccgtcaccgcctccccacagccaggaaaccccaccccgcgccttttccgcctgcctgccgacaaagctatcttgaaccgcatgggattcaacaacctgggtgcagcagaagtcgcaaaaaacctgcgcaaccggaaatccaccgatgtcatcggcatcaacatcggtaaaaccaaagtggttcccgctgaacacgcagtagatgactaccgccgttctgcatctttgttaggtgatcttgctgattacctggttgtcaacgtttcctcccccaacactccgggtctccgcgatctgcaggctgtggaatctttgcgaccaatcctcgccgcagtgcaggaatccaccaccgtcccagtcttggtgaaaatcgcaccagacctctccgacgaagacatcgacgccgtagctgacctggcagttgagctcaaactcgccggaatcgtagccaccaataccaccatttcccgcgaaggcctcaacactccttcaggtgaagtcgaagccatgggtgctggcggaatctccggtgctccagtagcagcccgatctttggaggtactcaagcgcctctacgcacgggtaggcaaagagatggtgttgatctctgtcggtggcatcagcacccctgagcaagcctgggaacgcatcacctccggcgcaacccttctgcagggatacaccccattcatctacggtggccccgattggatcagagatatccaccttggtatcgccaagcagctgaaagctcacggtctgcgcaacatcgctgacgctgtgggcagcgaattggagtggaagaactaaacagaccaaacacacgtgccaggatcttgctgaaacagcggatcttggcacgtgtgtctgtcttttgtctgttctggtgcctcacatgccgctttggacttacaacttcaaagacgtactttattgcacaaaacgaacattgagtccataaaatctccattttgagaacaccgcaaaatcaggcaattctgcacggagcgcgctttcaataatgtcaccttgcgctacccacgactcaacatcagatccagctttccactgcggacgccctttgggagcatcttcgacatcaacaaaatttgctaaccagtagcgagtccacagctggattttttcactcaactcgttcgataaacctaattcatcaggatacgtcacaaaccgtacccctttcctcggaaatggcaccttgtccgcccacagcgagtttcggattccatattcgagatttaaatatagagttggcttcttcattgtgaatcatcccctaagcgtgaaccacaggcattccagtcacctgattctggctcatcaccagctcacgcagtaacaacagtattcatcgacgaaaccacctcaacgctactagtcgatcaaaggctttttaacgggtcgagattctgggttaggtgtttgtatggcgttgtgggtttgaggccctcagagacgattctggaaggccactttcttttgatcctggcggcgatttttcggtgcttggtagcggaatgtcaatcgagaccaagcgtcccccggcgggtcgattttttggtctcgaatgacagtttcgctctctggaaactctcagtgtcaggtcagtggtgaaccaccatccttagcaaggagttcatcatgtccatccccttctcagtccttcaggactacctggatctgatcagtcccgaagccttaccccagatcccacagcccccggcccctgcccccacagcaccccagctaccaccggcgccggacccacacagcatcgagtggccgatcttcccaccagatcgaatctccgccaacgggcgacgctactacgagccacaaacacgactcgagttcatgcggatctacaccaccctgccgcacggctaccgccagcccttccttaaagccaacaacatcggccactgcaccgttcgaacctggctagcagcaataagcaccttcagccgacttccccatgcttttgatgatgcccaccgcttcgggatcgaacgcaccaccccagtcgacgatgtcaccacactaacggctgatgacaaacgtgacctggtcataggatacttagctcaaccacacggtcagggccagcaattcctcacgttttaccaactccgtaagcacaccatcatggcctggtgcgccgctatgaccgacggggacttagacgctgatatctcaccccgccagatcgggttgatgaccacccgaaccgtggtcgaaatcgttcgactacgccacatgattgcccaacaactagaaagagccacgatcatggaaaacgagtacctcaaagaaatcgcagcgctgaagaaagaactcgcgcactacaagcaaaaagaccatcagaatcaaatggtgatcgatatcttgggaaaagctattgggaccaggcccaatcctggcgagggcttagacgaggaggacgccacctaaacgtggatgagcaacgcgcctttgatcaaggactcaaggaagaaaacaccttgatcacagatctcaccacctgtgccaggctgagccataacaaggcattacggctgatcaagctgtcgaaatcaacggcgtattaccgcaacaagccgcgtccccgtcctgcaccgaaacctgtcctgcaggccgtgccagcaccaacagcacctggtgtggaacccacaccagagccttggcaggggaaggagccagcagtgtcgtcggtgcgtcaagcgttggcagaacacgaacgccagttcattgttgatgcgatcaccgcgtacccacaactgagcgttagtggggtgtttaacatgttgtttaacaaaggcatctaccgcgcatcactacgtacatggtggcgtgttgccaagcagcacaagttgttacacaaagaccgagtcagtgccctgtccccggggaaacgatcaccaacgccacgggttaagccgaggttggaagcaacacagcctggtcaggtggtgtgttgggatgtgacgttcttgccgtcgctggtacgtggtaagacctatgcgttgcatctggcgattgatttgttttcccgcaagattgttggggcgaaggtcgcgccgacggaaaatacctccaccgcggtggagttgttaacgcaggtgttagcggataatccgggtgtggtgacggtgcattcggataatgggtcggcgatgacatcgacgagggtgcggcggttgttagcggatcatggtgtggcgttgtcgttgattcggccgcgggtgagtgatgataatgcgtttgtggagtcggtgtttcatacgttgaagtatcggccgttttatccgaaggtgtttgcatcgatggatcaggcccgggtgtgggtggaggagtttgtggtgtattacaacacggttcatccgcattctggtgtggctgggcatactccgcagtcggtgtttgatggtagttggagggcggctcataggttgcgtgtgcaggcgttggatgcccattaccggcagttcccgcagcggtatgtggggcggccggtggttcaggaagttgctggtgtggtgcgtcttaatggtgcgcgtgatgatgggtctgtacaggagagggttggtggtgtagcgtcgctgttaagtgcttgagttagcatgtgttcttatcgcccccctggttcacaaacccctggcagcgagcggaaaagtgcatttttaggccaagggccctcggatcttcgagcgctttggtctcttttgcacgtctgaccgaaccagatcacctagaaacgccaaaggccccgcaagtatcaaacctgcggggcctttgaggtacctgtttcctattttgttgacttaggaagctgcgcacggcggataaccaaaccgcacagcaaggcagccactccccacgcggtgagccagaactgctccacgacataaacctgaatagttggaagcaaacgacttacgatcaccagggctacagcgatgctcaaagaaatgatctgtgtctttgagcttggctcgtacttgctggtggtagcgaatgcgccgagaatgatcgaggcaacgaggatcagaaggaatcctggagtgatcacaaatgggctcagcatgccggcggtaaacagctcaattgctgcaaacaccaacaaaaccagacctaaggctacgaaagctccaccgatgcggattgctgccggaactttacgccagctggcacggccttcgaggctggtgagcttttttaatgatcttcccgatgctgaactcataatgtgacataccctactagttctcgtaccatccccacacaattgacctgccaagagtgtggaaatacaggttgaagcctagaacagtgggggtagcgtcgggggcgatgtcgagtttttccacatcaagtgcatgaactgcgaagaggtaacggtgcggtgcgtggccagctggaggttgcgctccgtagaagccacgcttgccggaatcacccttgagggaaactacgccttcgatgccgccgagggtttcatcgccagcaccggtggggatctccgtgacagttgtggggatgttaaacactgcccagtgccagaaaccagcgccggttggggcatctgggtcgaggcaggtgatcgcgagggatttggtgccttctggaagatctgaccaggacagctgtggggaaatatcggtgccaccgagttgggcttcggccagctttgcaccgttttccaagtcggtggaggtgagggtaaagcttggcttttcaccaagcggtgcgtaggggtctgggcctgggaaacgatcgtcttggtaggtgctcatgtcttcgtttctaccccaaatctctagagtttgtggtggatttgaactattgagcactccatcgttgatacagctgcgcgtagcggccctcaaaagcaagtaattcctggtgagtgccgtcttcggtgattgtgccttgttccatcacgatgatgcgatctgcgacaactgcttggtcaaggcggtgcgcaacaaccaaggtggtgcggtttcgtgcgatttctgtggcggctttttccaacatgcgggcatcatcgctgccggcttcactggtggcttcatccatgatcaacacaggtggattgcggagcacgatgcgggcaagagagatttgctgttggatttcaggggtgagttcttctgcgccggcgccaattttggtgtctaatccggatggaaagaaacgtcgaaaagcagttgtcatttgcccgagcccgaccgactcgagcgctgcgtggagctgcgcgtcggtggcgtgcgcattggccatgcgaagatcctctgccagagtgcctgcgaaaaggtggacttcctggctgatcagcgcaacctggcgggtagtccacgtgtcggtgacggtggcggtgttgatgcccccgaccaaaacggcgccggaatcagggcgctgcagccccgcaatgacgcccgcgagcgtggattttcccgcaccagaagtaccgaccagcgctgtggttgttcctgcttccaagaccagattgaaatcctccaaaatggccacgccgccgggatatttaaacgtcacgtcctgcacagtcacggagggtggttctgtgcaatcggcagactcagacagctgttcggtgcgacgagccatctgggcaagggacaccgcgcgaccaagagaagtagacgcactctgaatttccgatgcgaagaacagcacgttgaacacgtgaatttccatgcgcacaaccacgaaaactgctgccgttgccgctccaatgctcatcgcatcctgggcaacccaaaacgcactgagcccaaacacgccaattagcagcaggccataagcaatcgaaccaagggcgagcagacgagtgaaaatcggcgcgcgatcagctgttgcttgcaccgcagtccacgacgcttggcgcatccgctgcacaccccacgcaccgagcttgagcacacgcagtgtttcaatgccacggatcgtatcgaggagcagattgtttcgacgcgcctccgtactggacacaatatttgttgccgaaggaatagctcgcacggctttccgaccgctgggaatcagcaccacaatcactgcgatgaacaggatcacaaaggtccagtgaatggtcatcaacgcgaacaaggagctgggcagaatcaaaatggtgatcaccaaacgcacacctaccatgccgacgatgcgcacagtgttatcgatgtcttgcgtcaggcggctaatcacgtttcccgtgcccaattccatgacatcaggaaccggtgcacgcaacgccgaagacagcgcagctttccgcagatccaccgacaggcgacgtgccaaggtgttgatcaccaattgcagcagcgcgcgaccggcagtttctgctaaaattccagcgcccaccaaaccaagcaaccagatcattgcggtcgatcctgaaccgatcagcggcaacgactgcccattgatcagatcaacggaatagcccaacaagttggacgtgccgaccatcgccacgaccgtgaccacgctaataaccacgaaactcacataccaccaggccttgggccccgaaggcatcgttttcagctcacgccacgactccgccaacgacgccggctgcagcgcatccgcaacgcgctcatgctgcgccatctacttcaccccttccgaaaaatcagattgcatctgctttgcgacgccgtgccacgtcgggttcgacgtaatgacgacggttttccggcctcgacgaagcttttcgacgcgatgtgccacttcatccagggtcaccgcatccaaccccgtggtcggttcatccaaaatgagcacctcaggatcaacagccaagaatcgtgccaaagcaatcctctggcgttggccaccggagagattcaatccggcctcgccgatcaaggtatctggaagctcaaactcccccggcatgttcagatcagcacccaatcggctcaagatgtcctcacaacttgcagcatgaagagcagcgcgcagcatctccggtgcgatagtgcccatcggattcaaattatccttcagcacaccttcaaacacgctgacgcggtgaggagccacaatgacatcttcacgaacctgaagcgcctccaactcccgatcaatcacatcgcgtgcctcaggtgtcgaaggatcccacaccgtgatcccctcttcaaattcaaaggtggcaggctgaggtcgtggctcagcggccgccttatccagttcagtgactaagttttggaccctttttgtcgaagcctgtcccctagcccaaatctctgtcatcatgccaagcgacacacccaacacagtcaacgaaggtggcaccagcaacgtcaccgagatcatctcaccaccagttatgtcaccgtcaaaagccaacagtgacgcataagccaaaagacccacagaaaacaccgctgggacaagttggcgcacaaaagtcagcaacgactgcagacgaacttccttcaacatgattgccaaggcttcatcagccgctgcgccaaagcgctcctcagtttgagaaacagcgcccaaacctttcaccaccctggatccctgcgccacatcggtagccaaagacaccgacttcgattccgcctcacggcgtttcgcggaaatcttagtcaacggagttgccgtgaaataggaagccaacgcggtaaacactccacccaccacgagtaacaccgcaatcagcggagaaatcggcgcaatagaaatagtggaacccaacaaatagcccaccatcatgatgggaaagttcagcacctgcttcaacccaccaatttgaaccgagtcctgatcgaccgtattcaacatctcaccaggagtcagcgaattacgtggcgtagtaaccaacttgcccgaaagctcaaggcgcaagttgtgcactaccctggcactcgctaaatcagtcaatgcatcagccgagccctccaggatgtagatcacccacaacagcacagccagcgccaccgataccaccagtactggcatcaactcacctgagccaaacgcccattccgagccacgcccaaccaccagcgacaccacagcaccaaacatgctggacaccaacatgccgaataccaacagccacgtagcagcaggaaacgcccacagtaacgcccaagcacttttaactggcgtggagttctccaacttgggaagcaagggtgtgccctcatctggagaatccggaacaaaccaggaccatgtgcgcatcctggggaattcatttgtcatggcgaaaacactaccgcagctttatacggacagtacttacaaagctgtaagtacaactttgtctttttagctaatgacctgcagatttgtgttcaaggaaagattcgggctattgtttatctcgtgccaagggcaataagccctaaacacccagcccgggtggcggaatggcagacgcgctagcttgaggtgctagtgtcctattaacggacgtgggggttcaagtccccccccgggcacactgtgttgagacagtatttaagactctgaactttattcaagtccagagtcttaccttatgccttatgttttactcacacacccagcccgggtggcggaatggcagacgcgctagcttgaggtgctagtgtcctattaacggacgtgggggttcaagtccccccccgggcacaaattagttaaatcaccctgtacaagattacttcttgtacagggtgattttctgtttctcctacggctgctcaaaaatgcattgtatactgcgaccactacagctgttttgactgctttgttttgggaaatccagttatcttatttcttttttgacgcctaccattgttccaatatgtctttgcgcggacgcgattgtgtctcacgccaaaaatctaacctgatctgacacggcaatgaatcccaactgcgtcctgaatttcgatattcccgagttccaacgctgctcggatgaccgagacccgcgtactccctccaaccttcagaacgcgaatacccacgttcgcgatacttgccaggagctaactcccaggaatacagctgttcgccaggaaagaaaaaagcatcacgatcacctgatgattcgacaccaaaataggctggttcagtcccgaagaactcaattccctgagctgtaatgaaaggacattggtatggggttgcctctgacatcgtttgagctctccatccttttcatttcgctattctggtatccatgagtcccaccgttttgcctgctacacaagctgacttccctaagatcgtcgatgttctggttgaagcattcgccaacgatccagcatttttacgatggatcccgcagccggaccccggttcagcaaagcttcgagcacttttcgaactgcagattgagaagcagtatgcagtggcgggaaatattgatgtcgcgcgtgattctgagggagaaatcgtcggcgtcgcgttatgggatcggccagatggtaatcacagtgccaaagatcaagcagcgatgctcccccggctcgtctccattttcgggatcaaggctgcgcaggtggcgtggacggatttgagttcggctcgtttccaccccaaattcccccattggtacctctacaccgtggcaacatctagttctgcccgtggaacgggtgttggcagtgcgcttcttaatcacggaatcgctcgcgcgggtgatgaagctatctatttggaggcgacgtcgactcgtgcggctcaactatataaccgtctgggatttgtgcccttgggttatatcccctcagatgatgatggcactcctgaactggcgatgtggaaaccgccagcgatgccaactgtttaaccctgaaggcgatttaaggggtcgaggatctcagagtaggccacggtgtgggtgaggccttttcaaggtcgcagaagcgattctggacggtctcaattttgggactcatgggtcagatgtgattcctgccaattcactgatcaagagctcaccacaagcaaaccccagaatccaaaatcgaatggatttttgcataatagcgacccggaagcgcaaaaatctaccacagactgcaagttttcagcattctgtggtagattttcgcatatttgttcgcccaccatccaaatggtgccttattaggctttgtcgaacgcctccaggatgttttgggcagccaacgtcggggtggtggaacctttgcggagggctcgttccatgtcttggctcactacttgaacaccgggatcgttttcgagacgcatgcggatagtttcatggaccatcgaccaagtccatcccacttgttggtcgcgtcgtcgcctgtcgaactcccccgcctccaccatggttttgtggtggttttggacatgatgccaaaaggtgtccacaccagtgccttcgacagctgacatggtgattgttggtggatgccagagttcatcggggctgcgaaccatgcggagtgcagaagcgaggtcgcgggctgctcgttttgctggtttttcgttggggccgtcggctttgttgatggccaccaactctgccatttctaagacaccttttttgatgccttggagttggtcgccagcgccggacagcgccaggaaggtgaagatatccaccatgtgcgatacggcgacttcgctttggccgacgccgacggtttcgacgatgatgatgtcgtaacctgcagcttcgaaaaccaccatggcttcacgcgttgctttggccacaccgccaagtgttccggcagaaggtgacggcctgatgaaggcgttttctgcgttggaaagcttggacatgcgggttttatcgccaaggatcgagccgcgagttttggtcgaggacgggtcgatcgctactactgccaccttgtgtccctgttcaatcaggtgcaggccgaaggcttcgatgaaggttgatttaccaacaccggggactcctgtgatgccgatgcgcagggcgtttccagaatgcggcagcagcttgaccaggagttcttgggccaaggcgcgatgggctggcgcagtggattccaacagggttatggcacgcgccatgagggtgcggtcgtgttggaggacggcgtcgtaaagcaattggacgtcgatgcgctgcctggcgcgcttgagcgcctccggagccactgcggtgctgcgccctaaatcagtgcctccggtggtggtgagggtacctaggttgtcttctaggaaaccgtgatcactcattcacatccacatccaggtcaaagcccaggtgtgcggcgagtcgggtgatcagatcgatcgccgactccgcgatgacggttcctggagggtaaatcgcggcggcacccatatcgtagagatcctggaaatcgcccggcggaatgacgccgcccacggtgaccagaatgtcatcgcggccaagagctgcaagttctttcttcagctcgggcagcaaggtgaggtggcctgctgccagcgaagacatacccaccacgtgaacatcggcgtccacggcggcgcgggcagcttcggctggagtttgaaacagcggtccaacatccacgtccatgcccaggtcagcataggcagacgcgacaaccttctgtccacggtcatgtccatcctggcccatcttggcaataaagatacgtgggcggcggccttcctcagcctcaaaggcgtcagccagggcgatcgcgcgttcgacgttgctcactgtgccttcctttccaacctcatccttgtacacgccagacagcgtcctgatttctgcttcgtggcggccaaagacaacttccaaagcatcggagatctctccaatggtagcttttgcgcgcgcagcatcgacggcaagtttgagcaggttctgatccaaatcccctggctctttatgctcgttgcgggcagcagctgtcaacgcatccagcgcagccttgacttccgcatcgttgcgctctgctttcagttgcgcgagtttagccaactgttctgcgcgaaccttggtgttgtcaaccttgaggacttcaatttcctcatcttcttccgccacgtagcgattcacgccgatcagcgcctggcggccggaatcaatgcgagcctgggtgcgtgccgctgattcctcaatgcgcagcttaggaattccctgcgcggtggcctgcgccattccgccggcttcctccacctcatcgatgtgcttgcgcgcgcggttagccagctcattggtcaaccactccacgtaataggagcccgcccatggatcaactggacgcaccgtgccagattcctgctgcagcaacagctgggtgtttcgggcgatacgagcagagaaatcggtgggcagcgccaacgcctcatcaagtgcattggtgtgcagcgactgggtgtggccctgggttgcagccatcgcctcaatcgcggtgcgggcgacgttgttgtacacatcctgcgcggtcaacgaccaaccagaggtctgcgagtgcgtgcgcagcgactgggacttggcgtttttcggatcgaattttgccaccaactcgctccacagcagtcgtcccgcacgcagctttgcgatctccatgaaggtgtacatagaaataccccagaagaaggacagacgaggcgcgaacttatccacgtcaaggcctacctctttacctgcacggatgtattcaataccatccgccagagtgtaggccagctccaaatcggcagtcgctcccgcttcctggatgtgatagccagaaatcgaaatggagttaaaacgtggcatcttcaaggaggtgtactcaaagatgttggaaatgatgcgcatcgacggcttcggcggataaatataggtgttgcgcaccataaattctttcaagatgtcattctggatcgtgcccgcaagctgctccggacccacaccttgttcctcagccgccacgatatagaacgcaagaatcggcagcacagcgccattcatggtcatcgacaccgacacgctggacaaatcaatgccatcaaacagctgacgcatatccaaaatcgaatcaatcgccacgccggccatacccacatcgccgaccacgcgctcattatccgagtcataaccgcggtgggtcgctagatcgaacgcaaccgacaaacctttttgacccgcagcaaggttcctccgataaaacgcattggattccgcggcggttgaaaagcctgcgtactggcgaatcgtccacggctgattggtgtacatagttgggtacggcccgcgcataaatggcttttgacctggcaaagaatccaccggatgtcccgccgcttgcgcctcgtcgcggtcagcctgcgtgaatacgcgcttgacatcaatgccttcgggagtgttccacaccttgccggcgtcaacgttgtgtgactccgatgcacgtgtctcagcagtcaatgggatgtctgaaaaattagggatcgacgtcatgatttaagctcccaaagcatctagcaggtcagccagcgtcgccgcggcatcaattgtcatgttcaaataaccatcgggcgcatgcgcgctgccctcaaagctcttcggcgcgccagcaagcaggatgcgctcaacgcccgcttcgcggagcttttcgacggctccctcccccgtttcggcatactcttggtccgttccacacaccactacaatgcctgcggcctgtgcagcttctgcaaaagcgtcagtgccgggaacaagttgacccgggttgattgcttcaatgccaccggaagccaacaggttggaagtaaaaccagtgcgaatattgtgcttggacaacggtcccagaggaatcatcgtgatctgtggcctcgcgccgttcttttccaagaaagcatccgaacgattgcgcagcgcttcaaaatccgctgcccatcgacgcacacctgcaggttctacccgacgatcagctggcagcggagactccgccaagttcgggaactcattaattccagtgagcttcttctttctcgacgccacatcagcgcgagtctgctcccacgtctgatcaagcatggcagtcaccgtgccggatgcacaagctgcactgtatccgccctcagcttcgatgccactgaacacagcccacgccttctccgctagatcatcggtgaagctctccacgaaatatgatccaccagcaggatcaaccacgtgaccaagatgtgactcttctagcaacaacaaattagtattgcgcgcgatgcggtgagcgaaattcctcgacactccaggaactccatctgggatcgcatcatcaaaagtacgaacctccacatcggttgctccaccgacgcctgcagcgaaagctgcaacagtactgcgcagcatattcacccacggatcacgctggctaaacatcgctcgtgcagtcaccgcatgctgtggtgctacggccagctctggaaaaccaagcacctcacacaccctggcccacagacgtcgagccacacgcagcttagaaatctgcgcgaactgctcatcggtgaccgcaaaacggaacgccacctgcttaagtgcagcttccgtggaaaggcctgcatcgaccaagcgacggacataatccacaccggcggcgatacttagaccaatttcttgagcatccgacgcgccctggttggaaaaactggaaccatccaccaagatagcgcgcacattcgcacgcttggaagcattcactgccaactgaactgcttcttcaatggtgtcactgtgcgaaccatcaacctgcgccgtcaaaggacgagaacccaaggtcaacgcagcaaaaaacgttccggcttcctccgccaacgtatacaacgccgctgcaacctctgacgtggatccacccgcatgaatcagcaacggagccatgttgagatacacgccttcgagagcaactttaagatcagctgccgtgaattcctcagagaactcaaaacccaatgtggtggtgccagaattcagagcattcagcaccgcagcgttgatattcttcgggctgtcatgtccgaaagtctcagtaacaccccaaccaacgcgttcaccatcaacagtggttcccctagtgaagggaaactcaccaggaacctcagtgaatttcctctgggactcatctgctctggtgtacagcggattgatatcaacaccatccggtgtagtgacgatgagtttcttccacacatctacggcaatgtcgccgatgtcttttttctgtgtgcgcgcgaaaacaccggccacagccttgtaccaagtttcgaggttctctgaaagttcctcgggcaccgcagtctttgtgagatcagtcaacgtagacttactttctcttgcttatggatagctattggattgcttttgtgtagggagttcacaagcttgtaaagccttcacctgtgtttacctacgaaaattgccgaacttaatacccttctgcgaacagctgagcagggatcggcactagcttctactacgataacgagaactttgtttcaatacattcaaaatggcggaatattttgatcacgggggtgcaactgtatggtgttttctatgcatgacaaaggtgagacccaggagaatcctgcggacatgtcaggacgcctaaacacaccaatttccacggtctttcacttctttagctcacttttccatgacgctctgcgcagtgttgcccagtggagtgcgtggaagaaaatcgctgtatcggttgtcatcgtcgcaattatttccgtaacttttcttgtcgatgtccccccgatttcggtttatcgtgactgggcaaacaacgccggcgacgcttttgtcttagttttttgcgccttttatatcctcattactcagttccctatcccccgcacagttctcacactggcctccggcgtgctgttcgggccggttcttggatcagtcgtggcgctgggttccaccacagtgtcagcggtaatctcgctcctcattgttcggggtctgcttggcgattggatggcgccacgtttaacgcaccccgcagtctcacgcatcaatacccgacttgagcaacgtggatggctggcgattacctctttaagaatgatcgccgctatccccttttccatcctcaactatgttgcagccttgactagcgttcctgttttttcttttgccatcgctaccttgatcggatctgcaccaggaaccatcgtcaccgtcgttttgggagatgcagtcacaggttctggaaactggactgccgttgcattcacggtatttttagcgattttgggtgttttaggtatctttttagatcaaaagatgccagtcaagcctggaaagtagacaatataaggtagggttggagaagattctttacttcttcactcattcgccctgacagcgaatccactacaataaacaaagggggcagccacccatgtgggcactgcatgccagataccgcggccgagacacacgacgagccgaattggttaaaagatttgcagaagctttgtccaccctcgaaggtgctggccagtttgaagtcattggtgtcgaagacatccgagcacacatcacctcaccgttaaccacatgtgatgttgtcatggcgctactcgcagctggcgattgggcaatcggaattggtgttatccccaccgttgacggaacagtcgatgaatcggatgaggccatcatcgaacaggtaaagaaaatttcctctgatgctctgcgccccaccgccaaggcgggaacggtcaaagttaggatcgccggaaccaaacgggacaatactcaagccttcaacatctccgctgcattcacgttgattgggcaagttctgtcaaagcgcaccatcgaaggacgcgaagccaccgcactcgtccgttctggactgaatcaaaatgaggcagcccaagagctcggtatttccaagcaggcaatgtcgcagcgattgcaggcggcaggttggcaggcggaatctgctggttggcaattggccgtaaacctcatcgagcaggctggcaagcgctagcaggcgatttaagagcctgagtttgtgagatgagcatgagagtatgggtcgactcatttcaggcgttgagaagcgaatctgagaggttgaaattcccaagctctgtggcggtttttctcacgccatgtggcagacctcaccaggtgaccgaaaatcgatcgactggccagtcttcggtcatataggacggtttttagaaactacaccagccagatcgactcgaacgagcgggattttaggcctgttcttcatcaacatggttgtttagacacaaataaggcgggaaacatctagtgtttcccgccttttcttatgcctgattagtttccgtaaggattctctcggtgttggtcggagtaatcttcagggtttgcctgtggtgcagggaattcttgggcgaagtttgcggtaggaggtgctgcctcaacctcaggttgtgtagtggttccgttttgcaaagcctccaatactgcttcaggttcaacgcgtcgtgcggtcttcttggaaaggatctcaccgggttctggatcgactggcttgttggccacggcgtttgctgcggcgactgctgctgcgatttcagggtctgattcggtggagaaccagtcttccacgttgtcggcgtttgcgatgtcgcgggtttcttcatccacggtgtttggttcgtagcggaagacaccttctgcatcctttgcgccgaactgcttcgcaaaaccttccagagaatcggagaactggcttgggatgacccacatcttggaggcgttgccctctgcgatcttaggaagcttttcgaggtattgataagcaagaacctctggggtcaacttggcagacttgattgctgcgttgaccttttggattgctcgggcttcaccctgcgcctggaggtagcgtgctgcgcgttcaccttcggcgcgcaggatcatcgcttggcgttctgcttctgcgttcaggatggatgcgtgcttttcaccctcagcttggaggatcttggcttgcttttcaccttcggcagttttgatgtcggcttcgcgctgaccttctgcggtcaaaatggtggcgcgcttttcacggtctgccttcatctgcttttccatcgattgctggatggatggtggcggatcaattgcctttagttccacacggctgatgcgcaggccccatttggtggttgctgcatcgagctcgccacggaggcggcggttgatcacgtcacgtgaagtgagggtttcttccagggtcatgccaccgacaacgtctcgaagtgttgctacagaaatctgctccacaccgacgatgtagttgtccacgccgtagatggcgcgctctggttcgttgatttggaaggtcaccacgatatcgatggccacggtcaggttgtcttgggtaataacagcctgcggtgggaatgagaccacgcgctcacgggtgtcgatccttgcgcgtactcggtccacgaatggaaccagcagggtcaggccacctgaaacggtgcgggtgtagctaccaaggcgttcaatgacggcggcttcaccctggggaatcagggctatggacttgatcaccacgacggcgacaaagaccaggaaaactatggcgaggattagtcctgtcatcgttactccagttttagttgggaatggccagtactatttgattgttaaaaatttaggcttctttccatacaatcgcggtcgtgccttggatatcaatgacactgacaatttcaccttccgcgaaggtgtgtgtgggatccatgctgcgggcggaccaaattgaaccatccaggcggacctgcccgctggtcgctccgacatcttcgagcacttcagcacggtggccaacaagtgctcgtggtgaagagtccagaacctttggtttcagcagacgctttctaatggccggcctaatgaacatcagtagagcagctgaggccaccgcgaaggtgacaaattcagcccatactgggacaccgatgagtgccacgccggcggttgccaaagctgcaccgccgagcatcaataaggtgaactcacctactgccaattccaagccagcaagaaccaatgctccgataaaccaaattattgctcccacgcaggccaccctacataatttggaagggccaggcagggctcgccacgcaaaaacacacccgaaaaatcaggcgaggacgtcctctttactcaaatcgaggttggtcacaaaatccaccaaacgttccactgccccaattagggtgtagtccaaatcgcggaaggaattcacggcgttatacacacggtgccagccttctttggggtctgaccagccaactcgtttgcagatgccggttttccaatcctccccgtatggcacctcaggccacgccttaagccccaaacgctctggtttcacagcagcccaaatatcgatgtaggggtggccggtgacagcgacatccgcgggtagtgatttagtcatccgagtttctttagatccctcaacaaggtgatcagcgagcactccgatgcgtcgtccaggcccaggctgaaattccgcgagacgttcctccaggttgtctagaccttccaggtactccaccacgacgccctcaacgcgaaggtcgtgtccccacactttctccacgatggcggcgtcatggatgccttctacccagatgcgtgacggcgccgcgacctttgcttgcgcgttttctacacgcctggaaccagaattagatttacgtggtgcttgtttttccacgaaacgggtgaggttaacgatctgcccatcaatcatgaacgcacccttgcgcagcttgtacagcgcatcgcgtccgcggcggtcctcgagacgcacaaaatcaccatcgtaggtgcgttcaaaaccggtcacagcgccgacgaagccatctccacgaacttccaccacaaggcctggttttgcgggcacatcgggatactccggctgcttgttgcgggagtgtccaccaaaaatattgcctgcataggggtctgaaaaactcatagctcaccaccctagtcaaagcactgcactacacttccctaacactatggaaattcgagcaaacgtttattcaccgcttcaaaatactgccgtctggctaggtgcgtggctctatgaattagtgcccaccgaagatgtcatcgatgcgttcgtcgatctcggcggcccgcacaccttcggcgacggcgggctgctcgatatgctgcgaactttaaaagaattaacaagcacgcttatcgacgcccccttccacggtccgattttaactctcgcactcagcggcccaggccaagtgccggcgttgccggcaggttcacgcgctgcggtcttggcctccgcctcgaaggagggggcgttggtgctgggcggcgtcgataagcagcattcttgggcgcttattcctacgcgcggtaaggatgccactgagtggaatttggtggaggtggagggctttttgccggcgattgcgactgtctcgcccggtgaggcggatcagctgctccgtcaggcgacagatcaggcggcaaatatcattgagttaagtggctacgcttcacttgcgccgaaatctttgaagaatccgcgactaaccgtgggcatgctgtcagatttttacgacaccccggggcttccctatgcagtcccagagaggtcggcgaagctttttgcgcgcgcagatcgcgtggctgccatcgcagagaccgtgcaggaaaccatcggcgatcacagcctggatccacagttgattttcctgtggagccatattcggaccgcgcgcatggctggggtgagttatgccctcgcagagtttgcgagggactatcactcctagttggcagctggcgccgctgagcgagcgttggggttcacccgcgcggttttatgcttggcggtaccacagcagccgtcgccacacggtgcgccgttgacggaacttccgcgtgctggcagctttccaaggcgctcgataacgcgcttgagctctgcctcctcgatgagatcaaccacaagggctgcgaattcatcggtggggccaacggtagcgacacgctcgaccaccatgttgcgcttctcggcttcttccatcagctcggaatcaagatcccaaatgacttccatatgatcagaaataaagcctacagggcagacaacgagcgctttttgacccttctcgttgagctccactgcgtgatccacgatgtcaggctccagccacggagtgtgcgggctacccgagcgggactgccacaccacatcaaaatctgacacaccaacagcctcagcaatcagtgctgacgcttccttgacctgtgtggaatacaaggagccatcctcaggggttcccgcagcattgtccgcagtcagtggaatggagtgcgcggtgaagaccagacgcgcctcatctcgcagctcatcgggaagcttcgcgtaggaatcctgaaccaattgagccatggtggagacaaaacgagggtgatcgtagaactgacgcagcttggtgaacgtgatcgactgcccctgagactccaggtgcttgatcatgccctgaatatcttcctggtactgccgacaaccggagtagccaccccaagcggaagttgccaacaccagcgcgtttttcacgccgtcatcagccatttgttcagcggcctcattatcaaacggcttccagttgcggttaccaaaataaacaggcagcttgtgatcgcgagacgccaattctttttccacattggcgataatttccctgttcagcgcattgatggggctgataccaccgaagtggtggtaatgaaccgccacttcatctagacgttccggcggaatcccccttccgtgagtgacattctccaaaaacggacgaacctcctcgtgcccttcgggaccaccgaaggagagcacaaggagggcgtcaaatgcatccgatgtgcgttcattcatatgaggatcgtaccaacttttggttgatattgcataaaaacgcatgaaccacatcaagattcataggaggaaactaaatgaggcgtaccacgctctcggtcattccgctccagcgaacaggagaaatcttcacgacagaacccgaattcggagcctcaatcatctgaccatcaccgaggtaaattgccacgtgctgagacgctcccggaccatagaagatcagatcgccacgttgcatctcagaaggcgacaccttggtgccgtgctggtactggtagcccgtgtagtgaggaagtgaaattcccacacccgcaaacgcatacaaggtcagtccagagcagtcgaagccaaccttgttgtaatcgccgtaagagtccgccacgccaccgtcacggatacccagagttgggccattagcgttaccgccaccccatgcgtactgcacacccaactggctcatggcgcgcgcaatcacagtctcaatctgagcggaacgatcgccggaaataacctctgaagaatcgttgccggaggaatctgaatctgaagagtcagagcctgtggaatcgttgcctgtggaatcgttgtcgctggagttgctctgggaatctccagactcacccgtacctggctgcgttgggccttggatgtccgcaatatcggtcggatccgcgtcttcatcagttgggtaaggattttgagtagtggcatggctggactggctcgccgcaattagagcagccgcagcgatggaggctgcggtgagcgcctgttcacgcagtgcctgagcttgggcatcgttggccgcctgagcgtcagcctcacgttgcgcctgttccgctgctgcttgagcctctgcagcacgctgttgcgcggcggcacgatcattcgcttctgcctgagcttgcgcggcttgtgcagcttgggtttccgcagcttgcgcggcttgggcttgtgctgtctcagctgcttgcgcggcttgggcttcctccgccgcctgagcttgctgggcagcttcttgagcttcagcggctgcctgtgcagcagcctcatcggcacgacgcttctcctccgcagcagcctgagcttccgcttccgcctggatgcgagcctgctctgcctgctggaattcctcgtactcagcacgctgaccttgcagattatccgcctgcgcacgagcgatggccaagttgcgctcagccccatcacgctgggcaaccaaggtactgcgattgttagtcaagacattgagctgctcgctgtttgcggcaattgcagcctcggtctggacttgcttttcgacggcttccgcctcacgctgctcagcaacgatgcgggcctggcgcaacaccgattccttgttggcgttttccgtacggaggcgatcaagctcttcaacagctgcctgctgcttttccgcactggttcgcaggtaagtctgacgatctagcgcatcttcagaatttccattgcccgagatgcctgaaagccccttggaggttccgttttggcgatacgctgcacgtgaaatctcatcaaggcgctcttgggctgcttcgatctgcgcttgagaatcatcgagatccttcttggctgcaagtgcatcttggcgggcctgctcggcgattgcctgcgcatcatgcaaatccacgagggacttgttcacttcttcacgcagagcacccatttccagctcgacgcggttaatttccgcgtcagtgctggacaaagatcctgccaggcgggcgacttccccatcgcccgccgaaacattttcctctgcctgtgcaatggctgcgtcatccggattctgtggctgcgccaccgccggagtcatggaactaagcaaagctccgcttactgcaagcgcaatcaacgccctggtcaacgtgacaccttttacctgggtatgggtacgtcgaagagctgcccgcaccccagggcgaactgaatctagattggccacatgttctcctgttcaatccgaatcccttcacatatcaagccttgacgctagatacttgccaagaattgaaacgtaaagactccgcgttccgtagcggaaactatgggccactctcctcttcattgcaccaaccattcaccgatttattgcatctccagcaagcttccccgtttgcccaaatgcccatcagtaaaaagagtggaagtttcaaggtttaacgcttgataactactgttactcaaattgattcaagttttggaaaacaacccatgagtcgatatctgaacattaagtcaccttggtaacttttgatacatctttcacaacagttacataacaaaaggccagagcgtgcaaggttttgcatgttctggcctgcatgaatggctgagtcatgaaattttgtgatgtttatcactttgtggcacaaagtatgtgaattttccgcaatttgggaattttctcgacacctaccgaaagtgctataagtaaagctttagaactttacttataaagatattgcttttcgacgcacagacgcacccgcaacaaccacggcgattgccaaagcaaccaacccccaaatcagcaattgaccccaatcaatattccccaccgtcgattccgttacatcctgtaccaaaagctccgttcccagcacgtaatcagtggtcccaagcaaatcatgctgccctgactcaagcgccgccctcgaatgaacatcactcaccaccgcagccgacattggagcccgcaccacaacggtgtccagatccgtttgaatcaacagctcctgcgcaatatccctcaggttggaagtcatcactggagtttcatcaagaatcacgacccctaaagatccaaaatctgattcctttgcatctgtcacaacattaataaggtctttttccaaagtcggaaactggttgcctgtgtgctcccccattgccacggcatcatcaccaagctccgaagcgagctgcttgagatcaatattttctggaatcatctaaaaaccttcattagtgtcgggctcacgaaagagcgggaaccgactttactcaataagcaatgggggtgagtaagggggtgatagaaagtcacatcacgcacgtacccatttcgagcaaatccgacaaaaccgctgcctagggacattagacacgctagcaggccaaaattccatgacgttattgacgcgccaagaaccccaactttcccgccagaacgcttgtactgttaggataatgaagacgtagggtccttttccacagttctgtggaatgagaatccgatgtttttctcacgccggctcagccgaagcagacgccgtcgcgaaatctcaccctaaaaaagttagaattggagctcactgtgactgaaagcaagaactccttcaatgctaagagcacccttgaagttggcgacaagtcctatgactacttcgccctctctgcagtgcctggcatggagaagctgccgtactccctcaaggttctcggagagaaccttcttcgtaccgaagacggcgcaaacatcaccaacgagcacattgaggctatcgccaactgggatgcatcttccgatccaagcatcgaaatccagttcaccccagcccgtgttctcatgcaggacttcaccggtgtcccttgtgtagttgacctcgcaaccatgcgtgaggcagttgctgcactcggtggcgaccctaacgacgtcaacccactgaacccagccgagatggtcattgaccactccgtcatcgtggaggctttcggccgcccagatgcactggctaagaacgttgagatcgagtacgagcgcaacgaggagcgttaccagttcctgcgttggggttccgagtccttctccaacttccgcgttgttcctccaggaaccggtatcgtccaccaggtcaacattgagtacttggctcgcgtcgtcttcgacaacgagggccttgcatacccagatacctgcatcggtaccgactcccacaccaccatggaaaacggcctgggcatcctgggctggggcgttggtggcattgaggctgaagcagcaatgctcggccagccagtgtccatgctgatccctcgcgttgttggcttcaagttgaccggcgagatcccagtaggcgttaccgcaactgacgttgtgctgaccatcaccgaaatgctgcgcgaccacggcgtcgtccagaagttcgttgagttctacggctccggtgttaaggctgttccactggctaaccgtgcaaccatcggcaacatgtccccagagttcggctccacctgtgcgatgttcccaatcgacgaggagaccaccaagtacctgcgcctcaccggccgcccagaagagcaggttgcactggtcgaggcttacgccaaggcgcagggcatgtggctcgacgaggacaccgttgaagctgagtactccgagtacctcgagctggacctgtccaccgttgttccttccatcgctggccctaagcgcccacaggaccgcatccttctctccgaggcaaaggagcagttccgtaaggatctgccaacctacaccgacgacgctgtttccgtagacacctccatccctgcaacccgcatggttaacgaaggtggcggacagcctgaaggcggcgtcgaagctgacaactacaacgcttcctgggctggctccggcgagtccttggctactggcgcagaaggacgtccttccaagccagtcaccgttgcatccccacagggtggcgagtacaccatcgaccacggcatggttgcaattgcatccatcacctcttgcaccaacacctctaacccatccgtgatgatcggcgctggcctgatcgcacgtaaggcagcagaaaagggcctcaagtccaagccttgggttaagaccatctgtgcaccaggttcccaggttgtcgacggctactaccagcgcgcagacctctggaaggaccttgaggccatgggcttctacctctccggcttcggctgcaccacctgtattggtaactccggcccactgccagaggaaatctccgctgcgatcaacgagcacgacctgaccgcaaccgcagttttgtccggtaaccgtaacttcgagggacgtatctcccctgacgttaagatgaactacctggcatccccaatcatggtcattgcttacgcaatcgctggcaccatggacttcgacttcgagaacgaagctcttggacaggaccaggacggcaacgacgtcttcctgaaggacatctggccttccaccgaggaaatcgaagacaccatccagcaggcaatctcccgtgagctttacgaagctgactacgcagatgtcttcaagggtgacaagcagtggcaggaactcgatgttcctaccggtgacaccttcgagtgggacgagaactccacctacatccgcaaggcaccttacttcgacggcatgcctgtcgagccagtggcagtcaccgacatccagggcgcacgcgttctggctaagctcggcgactctgtcaccaccgaccacatctcccctgcttcctccattaagccaggtacccctgcagctcagtacttggatgagcacggtgtggaacgccacgactacaactccctgggttccaggcgtggtaaccacgaggtcatgatgcgcggcaccttcgccaacatccgcctccagaaccagctggttgacatcgcaggtggctacacccgcgacttcacccaggagggtgctccacaggcgttcatctacgacgcttccgtcaactacaaggctgctggcattccgctggtcgtcttgggcggcaaggagtacggcaccggttcttcccgtgactgggcagctaagggcactaacctgctcggaattcgcgcagttatcaccgagtccttcgagcgtattcaccgctccaacctcatcggtatgggcgttgtcccactgcagttccctgcaggcgaatcccacgagtccctgggccttgacggcaccgagaccttcgacatcaccggactgaccgcactcaacgagggcgagactcctaagactgtcaaggtcaccgcaaccaaggagaacggcgacgtcgtcgagttcgacgcagttgtccgcatcgacaccccaggtgaggctgactactaccgccacggcggcatcctgcagtacgtgctgcgtcagatggctgcttcttctaagtaattagaagacttttgatgtggagtttcctccacatcaaaaaacgtaggtagcgaagggccccatcaactaattggccatgaataacctttcatggccaatgtggtggggtcctttctaatacgccaaatttttcaaacccatcctcttccatgcgtgttttcaccgctattttccataggagtacattgtgtccgtagcggcaggcgacaaaccaacaaatagccgtcaagaaatcctcgaaggtgcccgacggtgcttcgctgagcacggctatgaaggcgcaaccgtacgccgactggaagaagcaacaggtaaatcacgcggagcgatctttcatcacttcggtgacaaagaaaacctgttcctagccctcgcgcgggaagatgcagcccgcatggcggaggtggtgtctgaaaatggcctcgttgaagtgatgcgaggaatgctggaagatcctgaacgatatgactggatgtcagtacgcctggagatctccaagcagctgcgcaccgacccggtattccgcgcaaaatggattgatcaccaaagtgttctagacgaagctgtccgcgtgcgtttgtcccgcaacgtggataagggacaaatgcgcactgacgtcccgatcgaagtgctgcacaccttcttagagactgttctcgacggtttcatctcccgtcttgctaccggcgcatccacagaaggactgtccgaagtattggatctggtcgagggaactgtccgtaaacgcgactaaacgacccctgattcacactttcagactacaagaactagactaagcggtatggtttcagttcttttaattcagccccgtcagggagaagcagtcgccgcagctgagcgacgtgactttttgcaggccaccggtcttaagcctcaagaactgacctcccgaatgttggataccaccacttctcgaattggcagtctggaaggtttcgacggcgtgattgtgggcggaagcccactgaatgccaccaactttgagtacagcgattggcaacgccacgtccaccgcgaattgtccttgctgatcaatcacccactgccaacaatctttgtctgctacggcaatacctttttgaccttcttctctggcggacagattggtcgcacacaccccgaagattccggcgccaccacagtgttgctaactgacgccggcaaacgagacgtactcactcaagacctaccggatagctttacgtcctttactggtcacacggaaaactccgtagcgcccgcccctggacacgtggtgttggcaacgggaccaacctgccccatccagatgctgcgcgccaacaagaacacctggtcagttcaattccatgcggatatggatgccgtaggcatgaaaaaccgcatggatttttactccaactacggctacttctccccagaagattatgaccgcatcattgcagagctaccctctgttgactccatttatgccaacagggtgctccgcaacttcgtggaggtctgcgaaggaattcgtgttgctgatggtgctgagcaccaactcccagagcttaactaatcgaggagactggtgattcgccatccacgaaaggcagcacacgggtttgtgggaagtcgcgaaccacgaactcggtgataacttccgcaacgaggactcttgatgtggtgcggcctgcggctgcttcgttggtatcggcgatcacctcaacgccattgacttcatccagagttaaggctgctggtgcgaggataaggtaatccaggttggtggagcttaggtgctcatcagcggcctttttggattctgcatatgggtagaaggatgctgaaggatcaatggtgtgcgtggaggatccaatgtagctcaccatgatgtagcgaggtgccttctcccctaggctagctgcaccatcaatggatgcgatcgcggcatcacgatcaatggcataagttgcatccgcgccgttcttgccaccgtttccggcgctccacaccactacgtcgaagtccttgagcagatctgcccaatcctccacgctgagtgtggtgacgtcacgctctaaagttgtggcgcccagcgcctcaatttcggacctgtggtccggattgcggtacatggaagtgacctgcaccgaggcgtcgataagcatgggggttgctaggagggccaccttgccgtggccaccaatgagtagagctcgtgttttattagtcatgagcgccaccctaacaactcttagtttttcctgccgaaagcccagtaggcagcggggccaacaccattgacgatggtcaaaagcgcccatacccatttggggccgcggactttttcaggtgcgcgccgactcagcgacacccacacggacactttggtggcaaattctgcgaccgcgacagcaatgactggaaaacgcagttcagtgggcaaatccaaccaatcagcgtgcaatgatttatatgtcttggacgagcgattaaatagagttggcataccccaaatgatagacccaaagtgtcgtgtccaccgctcgttgtagcatgaacccatgtttgcaatcatgactgtcacagggcaggaccacaccggaattatcgccgcagtttccaccgcgttggctgagctagatgtcaatattcacaacgtttcccaaaccatcatggatcaatggttcaccatgatcttgcacgttggtttcgatgaatcggtcttggatatcgccacagttcaggaacgcatgaagccagtggaaaaggaacagggcttggttattcgtatccagtctgaagccttgttcaacgcggttaatgagatctagggggtgcacatggatgatttttctgcatcgctaggttttactgaccgttcctcgaggggaattctggacaccatcgagatgattgagaagtatcgtcttgatattcgcaccgtgaccatgggaatcagcctgttggaatgcgcgcgtggctcgatggaagagaccgcgacggctgtttatgatcgcgtgacgtcacaggctgcacgtctggttgaggtttgtgaaggcattgagcgtgaattgggcattcccattgtgaataagcgcatctcggtgactccaattgccctggtgactgctggttgcagtggcgatcccgttgacgttgctcgagccttagataaggcagcaaaagatgtcggagtgaacttcatcggcgggtattcagcactggttgaaaaaggtggaaccacctccgatattcggctgatccgctccattcccgaggcattgagcacaaccgatgtggtgtgtggatccgtcaatgtggcgtcgtctcgcgcgggtatcaacatgaacgcagtcaatgagatgggcaaggtggtcaagcaagcagctgaattgaccaaagatcgctccgccatcgcatgtgcaaagctagtggtctttgccaattctgtgggcgataatccattcatggctggcgctttccacggcattgaggagccggattgtgtggtcagcgttggtgtctcaggaccaggcgtggttagtcgcgcgctgggcaatcttcaaggtgccacccttgatcaagtcgcagaagagatcaagaaagcggccttcaagatcactcgtactggacaactggttggtgcgatggcctcagaacgcctaggagttcctttcggcatcgttgatctttcgctcgctcccactgctgaagtgggcgattccgtggcaaatatccttgaggtcatgggtcttgaccaggtgggcacacatggcaccaccgcggcactcgcactgctcaacgacgcggtgaaaaagggtggcatgatggcctgctcacgtgtcggcggcttgtccggatccttcattccagtttctgaagataaaggcatgatcgatgcggttcgcacaggagcaatttctattgacaagctcgaagcgatgaccgcgatctgctcagttggtttggatatgattgcgatccctggcgacaccccggcggaaactatttcgggcatgatcgcggacgaagcagccatcggtgtgatgaatcataagactacagctgtgcgtgttattcctgttccaggaactgtccctggcgatgaggtagatttcggtggcttgctgggttacgcgccggtcattccagtaaataccgtgggaaatagtgagtttattcaccgcggcggcttcattccagcacccgttcacgggtttagaaactaggagatccggggcctttacctgccattttccaaattcaaaggttaaagagctgttcacctcatcgtggggtgagcagatctgctgaggcgtatcatggacttataaaagttgaagcatctcctccgcgttgaaggtggagggctttcgccgcggaatggtccctcgtccaggtctttaattgatgtcttgacgtgatctgggcgggcacgcggccaatcatgtgaaaggtctgttttaggtgtcgtcccctctccccgctgccgtcacatcaaaacccgcccacgcgctttcctctgatgaggtgttagaaaatctcggggtccaggacaccggattgacctccgcggaggcaacacagcgtttggaagcaaacgggccaaacgagcttcctcaaactccacctgaaacagtctggcaacggctattccgccaggtcaacgatccaatgatctacgttctcattgccgccgcggtactcacggcgtttcttgggcattggacagacaccatcgtgatcggcgccgttgtcatcatcaacatgatggttgggttcatccaagagggcaaagctgcggatgcgttggcatcgatccgcaacatgctctccccggaatccgcggcgttgcgcgatggggtcttccacaaaattgatgcggcagagctggtggtcggtgacgttgtgaaactatccgccggcgataaagtgcccgctgacctgcgcatgctcgccgccaccaatctgcacattgaggaatccgcgctcaccggcgaggcggaagcagtggtcaaaggtactgatccagttgaggccgacgccggaatcggcgaccgcacatccatggcgttttcaggaacgctggtgctcacaggcagcggcaccggcgtggtcaccgccaccggtgcaggcacagaaatcgggcacatcaccaccatgcttgccgacgtcgactccgtggataccccattgactcggtcgatgaaaaagttctcatcggcgttagcaatcgtgtgtgtattcctagcgatcctcatgctggtggttgccggtctagtccaccacacacctttggaagagctcattctttccgccatcggctttgcggtggctgccattccggagggtctacctgcggttatcgccatcacgctggcattgggtgtgcaaaagatggcagctcgaaatgcgattacgcgccggttgaattccgtggaaacacttggctctgtcaccaccatctgcacggataaaaccggcacactcacccgcaatgagatgacagtccgcgcaatcgccaccggtacgagtctttatgacgtcagtggagcaggctacgaacctctcggggaaatccgcttaaaagacggcgagcaagtatccaagcaggatttcccagatctctacgccatggcgttggtcgcagcgaacgtcaacgacgccgaaatttaccaagaagacggcatgtggaggctttccggcgaacccaccgacggcggtattcgtgcctttgcaatgaaaaccaacgctgaaatcttgacccgaacagccgaagtccccttcgattccgcatacaaatacatggcgacgcttcacaccatcgatggagcaaacaccatgctggtcaagggcgctcccgatcgtttattggatagaagtgcacagcagcgcaacggtgaaccacttgaccggccgtattgggaacagctcatcgaggacctcgcgtcccaaggcctccgcgtgctggctgcggcatataaagagcttccccacagcacgtcaacaattactccagaagatgttgaccagggcgaactcaccttcctcgggctctacggcatcatggatccgccacgcgaagaagtcatcgaagccatgaaagtggtgcaatcggcaggcgttcgcgtccgcatgatcaccggcgatcactcctccacggcccgcgcaatcgcccgcgaagtgggaatccgcggccagaacgtgctcaccggtgcggaaattactgcggctacggatgaggagctgcagggactcgtcgataatgctgatctttttgtgcgcaccagccccgagcacaagctgcgcgtcgtgcgcgcactgcaagctaacggcgaagtcgcgtccatgaccggcgacggcgtcaacgatgcgccagcgctaaaacaagccgacgtcggcgtcgccatgggcattaagggcaccgaagccaccaaagacgcggccgacatcgtgcttgccgacgacaatttcgccacaatcgccggcgccgtagaaatgggtcgcaccatctacgacaacctgcgcaaagccgtcgtcttcatgctccccaccaacggcgcccaaggcctcgtcattttcatcgcgatgctgctcggctgggaactgcccatcaccgcacttcaagtgctgtggatcaacctcatcaccgccatcacactgtccctggcgctgtccttcgagccggccgagcccggcatcatgaacagaaaacccagaaaccccaagagcgggcttatcgacgccccctccgtgcttcgcatcgtctatgtctccctgctgctcggcggagcaacgttctgggctttccttggcgcccgcgacgcaggaatcgacatcgacaccgcccgcaccatcgcggtcaccacccttgcagtcagccaagtgttctaccttttaagctcccgatacttcgaagtatccgcgctgcgaaaagaactcttcaccaccaacccgatttcctggctgtgcatcgcactcatgctgatcctgcaactggcctttgtctacctgccgttcatgcaaagcaccttcgacaccgccgcactgacgcttagagattgggtcatgccactggtgtttggtgttgttgtctttgcggtcgttgaaaccgagaaattcatcaggcgccttaaagcgtcttaaggtttcagcccctcaagatacttgtcggtgatcctcagctgcaccaacctcaccacaggattagccagcttcgcccaccacttcgcaggctttgagaacgccacaatatgagcagtgacctggtcattgtcagccatcgtgatttcaaaagcctcttccccacgctccacatgcttctcgagcgtgccgtaaataaggatagcccggcgcgatccttgatgggacttgaggactctgcaatacgagcgaatactccagaacttgagctccacgattgagtcggattcagtcactgtgatccccgcgtgttgatgagcctcccaagagaacaactgttggacggcattttgaaagcactcttccccgtaaccaagcactagtttgcgatcagtgatctgccaaccttttgatgctttagcgtttccgattaaaaggtcttcggatgtaccgtgcagggactcggggtagctcaaaggggatgttttcacttttcaagggtgccatattcaagtgagatctatgagggtttaccagcccaatatacggcgatggttttagaggcaatcatcacaaatccttataaattcccccaactatcataaatgatacttcaccgtccattagactaattttggcctgtaaagagatcaacgttccacgattacgcttttgagtagtcgaggactaggagctgtttgatgttgtagctacatcactaaaaaatcgacagaccaaattcaatgatatttgctctgatttttggttctcgtctaatttcattattttgtcacgccagccatcacgacttcatacccaccaattgaaagtaaagtccaatgtttaccgcatccattcctacttatgaattagggtctttcagcaagggctcctacgttgagatcaaaggaacttacttctaccctgacacgctaaatactttatttagaaattctggggcaaaagacaacgaagagttctttgtagacgtaactcttgttccagaaccagataatccgcatagcactcgaggccatgccatttcagtccgctggaatgatctcgtaataggacatattgcctcggatatgactgaaaaattccaacaagtgcgacgagttgcagctagtggctacgatgctcgagtctctgctcggatttggacgaatacaaactataagaatgaacgagatttttgggtatctgttaagctccccgatccagatttccttgttcctcttaatgatcctccccatgacgggtttaccctcctcccttatggaacagcaatccaagtcaccaaggaatctgatcacatggacgtgctctcagaattcgtgcctccatctggacaaggtcagattctcgtatcgctacacatcattaacgcaggcgtgagaaaagaatgggatggcattgaagttcggctcgataatcaacggatcggagagcttacaaaggccagttcagaaaaattcgcacccgtagtgcgacatttcgatgacctaggacttagtacactatgtcgtgcgctcatcaaggggtcatcactagctgctgaagtaactctatatggagctcgtgcacatgagctttccgaagaagacttagaacctaaaagctcttccccattgcccaggttggttgaataccagtcaaatccgtttaattatcaagtccccaacaggtggcccggcgagcagaatcaacgtgctcctaagtcgcaaaagtcttcttcatcacctttcgcagcgtatcgcgggccatcgcaacctagtaaatcactcacaccgtttgtagcgcagacacctgcgcctcagcctagtgatcgatttattgattgggattcattgcttcaaccggacggaactccaagagctacgccattccaaagaggagtaacccgcgggttaattggcaagcatttttcgaatcaaaaatctccaagaattgactttgcaacggtggggcaatgtgatgcaattctccgaactttcggagagccgaccgacaagctttataaagacggcaggacttcttggcctttgtggtgggcgctcatggcgatagtcacccttctcgtcatgttgctgaactttattccaggaattggtccgatcttcccacttatcggattgatcgtacttggtcatcacttttggactcgccgaaaacttaacccaccattcggtagatcaaaatagatattctcatcaaatatcgctgatgcagcaaaacacctgggcaccaaaagatcaagcctgatggcggcaaatcactatcaaaggcgggatagtcaaatgcgagaattctgaaggttttccattgccaccacagatcaatactggataaaacagccttgatctgtggaaccatccttagaaccgaagctagcgccacaattttcataacgccatttacatcgttggatttcttcccagggtggttgaccactcaagcatgcaagcgtcacaaatattccggacattctgactaatttccctagagctgtagacagcagtcctgatgaatcaaatgaaacgccttatctctgtcgttgggactacatttatctttgcaactagctgctcagcaaccgattccgaggttgattcgccagctccgacaagtggagttacagtctcttcaattatcagatcttttgaacccaatagaaaagaagaactccttaacaagctcgtaaggttggctcctgtaaaccaagtcaatccacgcagagcttcccgtatcaggaaattacgatttcccaactccagtcgacctaggtgagccagattccgctgagatctacacagatagcggatccttccgatttgaaatatcccctgaagtattgaaagacgctgcatacttctgcactgtgtacacaaagaacggcaccatcactgattcttttgccgttgtgacctggtaggaagcctcacgggggcacccgttgcaagattcgagcggattaaagtattcacagacttcaatcagcgaagatgaaggtagagtctctgcgactccacatggctcatgtatggggaacacacccgacattctcaaaaatctaacgtgtcctacataccagccccctgacctgatactcggagttcttatatgaattatatatcccttaaacctctgcatccgtttgcgctcatgattctgactgctgccactctcactgcttgcagcactagtggtgaaacgatgtctacggaaacagagaccacccaatccactaagtcgagttccatgatcgctcagcctatgtgaccggatgagtgggaatcattagacgatattggcaaatcaataaatcaaatcaatgcgggatgtgcctttgtcctcgaagaaggcagcgttggtgcctgtggcagccctaattatggctattacagcttttctatgaataccgctgagaatccaagtgcatccgctgaacatcgtctgtctacagcgtttggagaacgcgaaaaagatgaggcagtacaagattgcaaaaaccttgaaaaagtgtatggcagcgatggttgggtcgacctcccccaggagacgttcatactctcctagacgatatcggagcagaggaatctgaagcagataaagttccaattgaatggcaaaacgccctgactaaggcagacaggtatgcaaaccggcaacacatgtctcaggcacgactctatcgccaattaaccagtgatgttggagagggcttcactgaagaagctgcccaatacgcaatcgaaaatgtgaacgcagactggaacgctaacgccctagtaaaagcaagaaattaccaggagcgccaagcaatgtcagtagaccgcatttacaggcaacttactagtgaacacggtgaagggtttaccccagagcaggcacaatacgcgatcgacaacctataaggcataaagatcccctccccacccaacagtttggcgaccatgggtggagagggggaaagagtatccaaaaaataagttccctagacacatgaaaagtgtatcgacaatcgtcgacagtcccaggaaaattacgaaaaatggttgaaaagtattgtgcaaagcatgcttgcgagaccccggaggtagacaactatccagaaccgttcgattcaaaaagaagcagccaccttcctccaggaagaaacccgaagtacccatcgcggagaatacctcaacgcccaagataatccagtcaaatatctcaaaactgccaatctgcatcaggtcaaacggtttgacattaccgatactgaagcactgtaaaagtagggtccacataacaaacgggtgatgcacacttcatctccgatgaacgagttgcaggccgccggagaaaggacgccacccgaaactgcaacatctgtgcgaactatccctattgccgatgacctcatcacggtgcttgaccacagagttgcggcgtccattcagggcgggatctttgaaaccgctcgcggtgctccataccgaattgcttctgccgacggtgaattaaggaagacagtgacgcgccttcgtgagtgcgtgacgttccacagtttccgccacctgtatgcgtcgaggttgatctcagcgggtgtctcggtgaagcaggttcagagagatttggggcatacgacggtatcgacaaccttggacacttatgtccccttcttccctggcctcaacaatcagccagcagctgaaatagcccgcatgatgaaattcatgcgggcaacttgcgggcggctaagtgcaggagtttaaaacgaaacagtcttgaccagcataaacagccttagaacctacgccaattccacgatttccatgtactgatcattccaaagatcctcggtgccatcaggaagcacgatgacgcgttctggctcaagggccttgactgcacccgggtcgtgggtaaccaggacgactgcgccggtgtaggtgcgcagtgcgtcgaggacctgttcgcgggagatcgggtcaaggttgttggtgggctcgtcgagaagcaggacgtttgcgcgggaggacacgagggtggccagtgcgaggcgggttttttcaccgccggagagtgttcctgctggttggtcgagttgttcgccggagaacatgaaggatccgaggaggctgcggaggctttgttggtcggcgtcggcgcaggcttcgatggtgttttgccagacggatttgtcggggtcgatggtgtcgtgttcctgggcgaagtagccgattttgaggccgtatccggtgacgatgccgccttcgccgtcggtgcgttccacaccggcgaggagtttgagcagggtggttttacctgcaccgttgaatccgaggacgactacgcgggagcctttgtcgatggctaggtcgacgccggcgaagacttcgagggagccgtacatcttggtcaggcccttggcgttgagtggggtttttccacagggtgctggttctgggaaaacgatgttggcggcgcggtcagctacgcggatttcgtcgaggttgtcgatcattcgttccgcacgggcgatcatctgcttagctgcggcagccttggttgctttcgcgccgaggcgtgcagcctggtccttgagggctccggccttcttttcggcgtttgcgcgctcacggcgtcggcgtgcttcatcgagtgcacgtgcatcgacgtatttgctaaagcccatgttgtagacatcggcttcgctgcgtactgcgtcgaggtaccaaatcttgttacatacggcgccaagcagttcgacgtcgtgcgaaatcatgatcagtccaccttcgtgcttcgccaggaagtcacggagccaggtgatcgagtctgcgtccaagtggttggtgggctcgtcgagaagcaatgtggtttttgatttgccggagccgttggtggcggcgaagaggatctgcgccaactcgacgcggcggcgctggccgccggacagggttttaagctgctggtcgaggatgcgtgcctcgaggccgaggttgtcgcagatctgggctgcttcggcgtcagcttcgtagccgccgagcgactggaattgttcctcgagcctggagtacttgcggatcgcggcgtcgagcttgccggggtcggtcgcggtttccatgatctcctgctggcgttccatggaggatcgcagctggtcaagaccacgggcggagaggactcggtcgcgggcggtttgttcgatgttgccttcgcgggagtcctggggcaggtaaccgatttcaccagatgtggttacggatcctccgtagggcttggtttcgcccgagaggattcgcatggtggtggttttgcccgcaccatttctaccaaccagaccaatacggtcgcctggctgcacccgaaggagctgacctggggcatcgagaagggtacgtgcgccaacgcgcacctctaaatcattggtgacaatcacaacctaacagtctatcaattgaagttgccaggtcaataaagctgcttttcgacgcccccagccacctacaacttaagcaatccgaggactgcaccgacgatgccaccaagcgctgccagcagcgctaaaagcgcgacaaaactgccaccgttagagcttccagcaacaccagtcgattcctcttcaggttcagaaggctgctcagtttctgacggttgttcttcggtgctggtgggttcctcttcctcaccagcaagtactttgaacgtggtctgagcagtcaattcatccagctcggcttcaactgttacttcatattcctcgtcttcagtatttactggcttgaggtctagctgaagctttgctgttccttgcgcgttagttggaaccacgtcccgctcaataccgttgacgcgaaatgcaatgagagtaccgatagccaccggcgatccatcgtgtgctgtcgccttcgctgcgatgacaatagtctttgtttgtccatcagaaaacacatctggatgattcatgatcaccaaggagttctgctgcacttgttcagacaggactgtaaaacgtgccaaggcatcacgcgcgattgatcgtggtgcatcttctggaacgacgagtcgggcgcgaacctcaaatgtgcgttcaggctgctcgcttgcgatgttgtccacatcaatcgagatgctggcatgcccttccgcatcaacagctgcggtatcaatgggcgatgaatctagataaaaggccaccttagatccagctggcagatctccctctgaggtgacattagcctggacctcaacagtttggctctggccgttggaatgaactgggttgatgggatcaaccgttacgattgcatcagtgacagcatcctgtgttccattgagttcaactcgaggcacatcaacgtttttggaccataccgtttcgcctgcggagttagtaaacgtccataccgttggaatatccacgtatccgcgttctacatccaaatcgctgacttcataggtagttgtggtgcagtcatagctcttattcgcgcctaaattcttgtaacgacagttgggagtaccctgctctggatcaaatccgcgtaggtttgcaggcatccagttctcgccttcccccaggcttggcaccgaattaaccgtaacgtcaaacgggttgttgaccgcaaagttaatgctgatcttctcccctgctacataagtgtccttgagatttggaatgctcaccttcactgaagttggtgcaggttcttgcccaccctgaacagtgagattgagacgacccgtgtagcggtctgctccatcaagaatggacacctccactggaagttcaccgttgtcggctaccagcggtgctgtgacctggactgggattgtgacagattctccagatgggatcgacacacgaacatcctcagcttgccatccttcgggacgttcaagggagactgctcggtcaaaaattgcgttgtcgaaaggattggtcaacgtgacattcatagtggtggtttcacctgcagtcacggacgtttcatcggcgtcgacaccaatgcagccggcctccagccacgacaggttgaactgtgagtagaagatgtcgatatttgagccactgttttctcacagcatgccgatgtcaccgttgggaagcgttgccatcgaggtatattggattgctcctggttcaaacaccttagacaccggccaggtctgaccatcatcacacgacatgcggacggtgccattggtgcggccactcgtggtggcagtgttggagaacagcagaacctttgcctgcgcacttccctcaggtgctgtcgggaatactcgaatcagggaagcattgttgcgaggatccggcagctgggtatcaagagttggctcggtccaagtgacgccgccgtcggtggaataagacaccttgcggtaagtatcggctcctgatgaacgactgttgttcatcagggttccatcgctgagttccacgattttgttttcatccatggagtttccccaaggagcactggggtaccacgttgcgccgtgatcatcactcagcatggcaactgctgcgactcgaccattggtcatgcgagttaccgatggctggaccaatcgtcccttgtacgcgccgtattgcagttggatgccgtttccggatgtggcaaatcggctgtcccaggtgtcatcagcaaccacttgatcagtaatgacggtgtctgcaacccaggttgagccgttatctgatgatttggcgtaggcaacatgggcaacgttgcgatcatccgggtccgtgcctggttgggaggtgaagtatcctgcatcgaatgacttcacgtggaagttaaagacatcgcccctctcccagtccacaacgatgctgggatcggaatagccagttttgggttcggcggtgatacctgcggaaatgtcgtgctgttcgccccaggttgctccgttgtcggtcgataccttgcccacgatggagttgggttgtggagcatctgaacagttgtttgggcgaccatcccacgatgcgaggacgttgccgttgggtgcgacgccaagcgatgggatgcggtagcaatcaaatccgagagttccgccgtcagcgagttgttgtgttgaaaactctggttcttcgctgatgcttgctgttgcatcgaatccgtagcccgtgggtgtttgagcttgggccgttgggatggtgggtagtgctgcgccgatgagtgcggctgcaccaagcgctgagaatactgctttacgccgagacaaagcacctgctttcttgaatggaagacccatccagattggaagcatgatgtcagatgtctaattgggggcatagacatgcctcccccacttcacccaccaggacgggttgtgtgcgggattttcttatcctacaaaacggtgctgttgcaaagttggggcagtaggaagaccggcgtggaataatcaggtccatgggcatcttctccggtcggcagttccctcgtgaaatcatcctgtgggcggtgcggtggtactgccgctacggcgtgagctatcgcgacctcgaagagatgatgaccgagcggggagtgccggtcgatcacaccacgatctaccgctgggtccagaaatatgctcctgagctggataagaagacccggtggtatcggcaagttcctgactggcaggccaggtcctggcgggtggatgagacctatatccgggtcgggggaaagtggtgctacctctatcgggcaatcaccgccggtagccagaccctggacttctacctctccccgaagagaaacgtcgcggcggcgaagcgtttcctggcgaagacgctgcggtcgaataaatcggcaggctatccgcgggtgatcagcaccgacaaggccccctcactcgccagggcaatctctgagctgaaggcggaaggcgtctgtccatcgacggtcgagcatcgtcgggtgaaatacctcaacaacgtcattgaaggcgaccatggtcggttaaagcggatcctggggccgaaaggcgcattcaaaaaccgaacgtctgcctaccggacgttgaaagggatggaggcgatgcactcattgcggaaggggcagggcacgatgtttgcctatggtcacccgaatccggatgcagtgattgttagccgggtattcgagacggcctgacaacacaggcacatagcgttgatcacacaataaaaacggagccttcttggctcccgccccaagttgcaacagcacctacaaaactcatgacacattgtcgtgtgaatcacaaagcttttaaatttcgaaaaaccacacgcttgtgcgggaaacttctcgcataactagggtgagggtatgacctccaaaggccaggaatctagttcagactccacagcaggaatggattacatcatccgatactcgctcaacgagtttcagcgcggaagtatcgtgacgcgttttgaaactccccctgataaacgggaggtgtttggggtcttagaaagatacggcatttcttccactcaggtaagtgaatattccgtttcccctgcacgcggagttcaacaggctctgacgccggtccaccaggacattgtggaggcgcaaccttcggaggatacttccccaccgcctctagacaggcggaagaggaaaagtggttgcgggtgggtagctgtagctatcgttgtcattgcctttgtgactccagcagtgacggccgagcgttcttacaccactggtcaaagtctcgcgccgtctgcctctagaaacttaagttttggagagcgatacgatttttgtgacgcccagttgagatatatcgcggtatctgatgagaactactgggatgaggcgcctgggttctttgaagaccgcgtctccaataatcctatccaccccgccaatctttctttcctcgttggatgcatgtctgactgacgccaaatatgcaacaaccccgtgtcgcacaggaaacctgtgtggcacggggtggcgtcgataagcagccttttaaaccgcgaatcctagggcctgcagctgagcgcggccctcttcggtaatcatgtgtggaccccaaggtggcatccatacccagttcagggacatcttctctgcaatgccgttgccgacgattgcggtgcgtgcctgatcttcgatgacgtcagtcagcgggcaagctggtgaagtcagagtcatatcgatgtgagcttcgttgccgttgatgatgtaaatatcgtagacaaggcccaggtcaacaacgttaatgcccagttcagggtcaataacgtcgcgcatgtactcctcaacatcgctggccttagccaggtctgcctcggactgctctgggcgctcagagctttgtgcttcaaaggtggaagcgttctggtcttcaacctctgtcgtgttctcggtgtgctcgctcatggtttcctccaattaatacagcgggctaatgtgcgtgcgcaacagcgtcagcggttgccgcctggaaagccttccacccaagcagcgcgcacttcacgcgtgccgggtacttggcgactccggagaaagcaacgccatctccgatgagatcttcatcgccaacaaactgaccgcgggaaacgatcatcttctcaaattctgtgagcttttccagcgccttgtcgacgggttggcccacgatctcctcggccataacggacgtggaggcctggctgattgagcaaccaactgcttcgtaggagacgtcctccacggtggagccgtcctcagacagcttcacgcgcagagtcaattcgtcgccacaagaagggttgacgtggtgaacctcagcatcgaaaggatcccgaaggcccttgtgctgtgggtttttgtagtggtccaggatcacctcctggtacatctgctcaaggttcattactcaactccaaagaattgcttggccttctcgatcgctgccgcgaggcggtcgatttcttcgaaggtgttatagagatagaaagatgctcttgctgtcgattgtacgttcatgctgcggtgcacgggccacgcgcagtggtggccgacgcggatattcacgccctgatcgtcaagcacttggcctagatcgtgtgggtgaatgccctcgacaccgaagctgattgcaccgccgcgctgctctgcagtcaaaggaccagcaatggttagtcccttaattgccgtgagcttttccaacgcgtaagcagtcaatgcgtgctcatgcgctgcgattgcttccataccgatttcattcagcatgtccacggcagcacccaagcccacaacctggctggtcatctgcgtgccggcctcaaaacgttgaggtgcggcagcgtaggtggaaccctccatggtgacaacttcaatcatggaaccaccagtcaaaaatggtggcagttcatccaagattggggactttgcatacacaacgcccacgcctgcaggtcccagcatcttatggccagagaatgcagagaaatctacatccagctcgtggaaattcactggcatatgaggaacagactggcacgcatcaagcaccgtgagagcgccgacagccttggcacgacgaaccaactctggaacatcagccacagcaccggtcacattggactggtgagtgaaggcaacgaccttgacagtttcatcaagctcgagtgaatcgagatcaatgcgaccatcttcagtcaccttgtaccacttcaatgtcgcaccggttcgacggcacagctcctgccatggcaccaagtttgcgtggtgctctagctccgtgatgaccacggtatccccggcctggacacgatacttaccggaacggtcatcacccaaggtgtacgcaacaagattgagtgcttcagttgcattcttagtgaacgcaatttcatgctgctcggcaccaacaaaggcagcgatcttctcgcgggcaccttcataagcatccgttgcttcctcagccagttggtaggcaccgcggtgcacgggggcgttggtgtgcagcacaaagtgctcctctgcacgccacacccgctcgggtcgctgcgatgtcgcacctgagtccaggtaagcaagcggtttcccatccctaacagtgcgcttcaggattgggaattcttcccgcaccttatccacattgagggatccatctgcattgaggaaatcggacatgttacttgatgaactggtcgtagccgtcagcctcgagcttgtcagcaagctcagcgccaccggtggtcacaatctggccattcgcgaaaacgtgaatgaagtcaggcttaacgtagttgaggatgcgcttgtagtgggtgatcatcaagatgccaccttcggtctcctgcttgtaggagttgatgccctcggaaacaatgcgcagtgcatccacgtcaaggccggagtcggtctcatccatgatcgcgaactttggcttcagcagatcaagctgcagaacctcgtggcgcttcttctcgccaccggagaaaccttcgttgactgagcggttggagaactcagggtcaattgccagagcttcctgagcggtgcggacttccttaacccactcgcgaagcttaggagcctcgccgcggattgcggtcgctgcggaacgcaggaagttagcaacggaaacgccagggatttcagttggatactgcatggccaggaagagaccagcgcgtgcacgctcatcaacttccatctccaggatgttctcgccgtcgaggaggacctcgcctgcggttacctcgtagcgtgggtgtccaccaagggtgtaagcaagagtggacttgccggaaccgttagggcccatgatggcgtggatctcaccagagttgatggtgaggttgacgcccttgaggatttccttaggctcagcggactcatcggacggcaggacctgtgcgtgcaggttacggatttcaagagtgctcatctgtcacaatctttcagggttgaagcgaattttaaactgaagtattagctgggccggtttttctgccgcccagcttggccaagtaactgtgcttagccacttggcttagttactttggcttaattacatgccaagaactgcgagttccgagctgactcggttgtccaattccccgcggatggattcaactgggaccttgttgatcacttcgttgaagaaaccgcggacgatgaggcggcgtgcttcctctgcaggaataccacgggcctggaggtagaacacgtgctcgtcgtcgaaacgaccgacggttgctgcgtgtcctgcgccaacgatctggccggtttcaatctcgaggtttggaatagcgtctgcgcgtgcaccctcggtgaggacgagtgagcggttagcttcgtaggtgtcagtgccgtgggcgtttgagcggatgagcacatcgccaacccagcaggtacgggcatctggcttgtcagagttcttgtcaccctgaagtgcgcccttgtacaagacgttggagcgacagtttggtacagcgtggtcaaccagcaggcgctgctcgaagtactgtccatcatctgcgaagtagacgccgagcatttctgcgtcgccacctggtgcggtgaaacgcacgcgtgggacgatgcggactacttctccaccgaaggttgccacggtgtggcgtagagttgcgtcgcgtcccagctgtgcaagctggttgctcaggtgaactgcgtcagcgttccagtgggtgtccgtgatgacggtcaggcgtgcgttgtcgccaacgatgaattcgacgttgtcagcgtgggtgccggatccgacgtactgcagtgcgacgatagcgtctgcgcccgcttcaacctcgatggagattgcgccgaaagaggtaacgccttcacccttgccagtaaccgtgatggttactggggttgggttgtgggagtttttggcaaaggtgacaacattgccctgttccttggaggtccaggcctgagctgcgacgcggtctactggtgcgcctgcgcgacccagtcgagcatcgtcctttgcgacaacttcgtggcttgcgccttctgcatctgcagggatctcgacggtgacgtcagaggtggttgcaggtgcgaactcgccgttgtggagtccgcgaagacggcgtagggaaatgaaacgccattcttcgtcgcgtccgcgtgggatctcaaagtcctcaacattaaatgaggagaagaggtcgcccttggtgttgtgcggggttgcggcctttacggttgctacttcagtcattgggcttagcccaccgatccttccatctgcagttcgatcagtcggttgagctcaagggcgtactccattgggagttccttagcgattggctcaacgaagccacgaacgatcattgccattgcttcttcttccgcaagtccgcggctcatgaggtagaacagctgctcttcagaaacctgggaaacagttgcctcgtggccgagtgacacgtgatcgttacggatgtcgttgtatgggtaggtgtcagaacgggagatgtcatcgaccagcagtgcgtcacactcaacgttggaggttgagtggtgagcgtttgcgttgatctgaaccagaccacggtaagccgcacgtccaccgccacgtgccacagacttggacacgatgttggaggaagtgtaaggagccatgtgggtcatcttggcgccggtgtcctggaactgtccctcacctgcgaaagcgacggagagaacttcgccctttgcgtgtgggccagtcatccagacagctgggtacttcatggtgaccttggagccgatgttgccatcgacccattccatggtgccgccctcttcaaccttggtgcgcttggtcaccaggttgtagacgttgttggaccagttctgaatggtggtgtagcggcagcgtccacccttcttcacgatgatctcaacgactgcggagtgcagggagtcggacttgtaaataggtgcggtacagccctcaacgtagtgaacgtaggcatcctcatcaacgatgatcagggtgcgttcgaactgacccatgttctcggtgttgatgcggaagtaagcctgcagaggaatgtccacgtggacaccctttggcacgtagatgaaagatccaccggaccagacagcggagttcagtgcggagaacttgttgtcgcctgctggaatgacggtgccgaagtactcctggaagatctcagggtgctctttcagtgcggtatcggtgtcaaggaagataactcccttttcctccaggtcctcgcggatctggtggtagacaacctcagactcgtactgagctgcaacacctgcaacgaggcgctgcttctcggcctcaggaatacccagcttgtcgtaggtattcttgatgtcttctgggagatcctcccaggactgtgcctgcttctcagtggagcggacgaagtatttaatgttgtcgaagtcaatgcctgaaaggtctgcaccccaggttggaactggcttcttatcaaaaatgctcagggccttgaggcgctgctgaagcatccattctggctcgctcttcttcgcagagatgtcgcgtacgacatcctcgctgagaccacgctgtgcggatgcaccagcgtcgtcggagtcgtgccaaccatagttgtacggaccgatggattcaatgatctggtcatcggtcaagggctcgttaacccctgggttcgtcgttgccgaagtcatgatccgctcctttcatcaggagtgtttgatgggtgtcaatggaatatttgttgtgcagatgccgtggccgtccgcgattgttgccaatggttgcgtgtgctgccccaaaagttctgagactgcttgatgctctgcctcacacagttccggaaattccgtggcgactgtagatattggacagtgatgctggcagagttgcaacccgtttcgagtggcatcgacagttgctgcataaccatgccgactaaaagcttcaactaaagatttggctgtatcttcgattgattgatctgtgacatctgctggggtaataccctcaacaattgtttcgatccgctttctagcaaattgccttactgcatcatctccgccgacctctcgaagagtggctagagctgccgcagcaagggaatcatattcgtggccgaagattgagcgacctttatcagtaagccgataagtttttgctggcctaccgcgcattttgggctcatatgggttctggcgcggatttgccgcctccgccagattttcttcaaccaagttgtctaggtgcctgcgcactcccacagttgaaagctgaagctgttcagcaatatctgaagcgatcaccggtgcacgttccaacaggatgagaagaatttttcggcgcgtatcaccgtctccggtgtgcgcgtcgttgccttttacaacatctcccactggtgtcacctcctgcttgatttagctttcacctttagacaacacaagtgttccctaattccattcccgtgtccaatcccttcccccctaccagcgcaaatagacgtagaaaaatcatcaataaataaaaactaagcgaaccctaagccaaccaaaggtaaccttatttatgctggccacaggtggtgtgttttaaaacttcattccaattaccgaaaatgaatataatttgagatttagctcacactatcccccttcgggtcaccaccagactctgatgcgaggtaaatgttctccgctcccttgcgtagaatgatgcgagtgacgaaggacgagcagattcaacccaattcgaacgcccctgaaaacagaaaatggtttcctcgggcacctcgtcccctacgccaatttctcgacactttgccgcgcatcggcaccgctggttccagatcagcgaccctccacgtggaagacgagcagagccctttaggggcaacgcttttcgacgtcgcgaccggcgcgagctccatcaacgaccgcgataccgacgcctcagggcttgagcctgaaaagattcgccgatttgcatggctgcgcctgatcggcaccatgggtgcgttaatgatcgcgtttggtgcgctgggcgcgggtgcacttccggtggtgaataatccgtatgtggatttccctggcggaaacttcatgagccgaatgctgcagacctcttccatgatcgtgctcatcggcgtgggatttttggtgctggcgtgggtgttaatggcaccgctggtgggtattccttttaaacgcagcggaaacagaacagccagcgtgagtttgtccatgctgcgccgcacatttggcgcctgggtagcgcccatcatgctcaccgccccactgtttactcaagacatttattcttatctggcacaaggctctgtgaccgcgcagggaatggatgcctacgccggtggaccgcttgaactattggggcccgataatcatctggcacggtccgtgccctttatttgggcccagtcgccctcgccctacggccctgttgcgctgagcatcgcggcgtcgataagcgttattactaatgacagcatcgttggaggcgtgc

(The sequence listing continues in the following parts.)

What is claimed is:

1. An isolated DNA encoding a polypeptide having homoserine dehydrogenase activity, comprising an amino acid sequence of homoserine dehydrogenase derived from a microorganism belonging to the genus *Corynebacterium* in which the Val residue at the position corresponding to the 59th position in the amino acid sequence of SEQ ID NO:6952 is replaced with an amino acid residue other than a Val residue, or a polypeptide comprising an amino acid sequence in which the Val residue at the 59th position in the amino acid sequence of SEQ ID NO:6952 is replaced with an amino acid residue other than a Val residue, wherein the Val residue at the 59th position is optionally replaced with an Ala residue.

2. An isolated transformed host cell, wherein the host cell is optionally a coryneform bacterium, comprising the DNA of claim 1.

3. An isolated transformed host cell, wherein the host cell is optionally a coryneform bacterium, comprising in its chromosome the DNA of claim 1.

4. The transformed host cell according to claim 2, wherein the host cell is a *Corynebacterium glutamicum*.

5. The transformed host cell according to claim 3, wherein the host cell is a *Corynebacterium glutamicum*.

6. A method for producing L-lysine, comprising:

culturing the transformed host cell of any one of claims 4 or 5 in a medium to produce and accumulate L-lysine in the medium, and recovering the L-lysine from the culture.

* * * * *